(12) United States Patent
Schuetz et al.

(10) Patent No.: US 10,047,397 B2
(45) Date of Patent: Aug. 14, 2018

(54) BREAST CANCER ASSOCIATED CIRCULATING NUCLEIC ACID BIOMARKERS

(75) Inventors: Ekkehard Schuetz, Goettingen (DE); Julia Beck, Goettingen (DE); Howard Urnovitz, San Jose, CA (US)

(73) Assignee: Chronix Biomedical, San Jose, CA (US)

( * ) Notice: Subject to any disclaimer, the term of this patent is extended or adjusted under 35 U.S.C. 154(b) by 0 days.

(21) Appl. No.: 13/641,616

(22) PCT Filed: Apr. 18, 2011

(86) PCT No.: PCT/US2011/032931
§ 371 (c)(1),
(2), (4) Date: Jan. 2, 2013

(87) PCT Pub. No.: WO2011/130751
PCT Pub. Date: Oct. 20, 2011

(65) Prior Publication Data
US 2013/0116127 A1 May 9, 2013

Related U.S. Application Data

(60) Provisional application No. 61/324,927, filed on Apr. 16, 2010.

(51) Int. Cl.
| | |
|---|---|
| *C12Q 1/68* | (2018.01) |
| *C12Q 1/6886* | (2018.01) |
| *C12Q 1/6851* | (2018.01) |
| *C12Q 1/6883* | (2018.01) |

(52) U.S. Cl.
CPC ......... *C12Q 1/6886* (2013.01); *C12Q 1/6851* (2013.01); *C12Q 1/6883* (2013.01)

(58) Field of Classification Search
None
See application file for complete search history.

(56) References Cited

U.S. PATENT DOCUMENTS

| | | | |
|---|---|---|---|
| 9,121,069 B2 | 9/2015 | Lo et al. | |
| 2007/0048742 A1* | 3/2007 | Kang et al. | 435/6 |
| 2009/0127589 A1 | 5/2009 | Rothberg et al. | |
| 2009/0299640 A1 | 12/2009 | Ellis et al. | |
| 2010/0035252 A1 | 2/2010 | Rothberg et al. | |

FOREIGN PATENT DOCUMENTS

WO  2009/051742 A2  4/2009

OTHER PUBLICATIONS

Beck et al. (2009) "Profile of the Circulating DNA in Apparently Healthy Individuals" Clinical Chemistry 55(4):730-738.*
Van der Vaart (2008) "A Method for Characterization of Total Circulating DNA" Annals of the New York Academy of Sciences 1137: 92-97.*
Extended European Search Report dated Feb. 5, 2014 for European Patent Application No. 11769758.1, 16 pages.
Beck et al., "Next Generation Sequencing of Serum Circulating Nucleic Acids from Patients with Invasive Ductal Breast Cancer Reveals Differences to Healthy and Nonmalignant controls", *Molecular Cancer Research*, vol. 6, No. 3, pp. 335-342 (2010).
Silva et al., "Tumor DNA in Plasma at Diagnosis of Breast Cancer Patients Is a Valuable Predictor of Disease-free Survival", *Clinical Cancer Research*, vol. 8, No. 12, pp. 3761-3766 (2002).
Di et al., "Peripheral Blood Mutated p53DNA and Its Clinical Value in Human Breast Cancer", *Chinese Journal of Oncology*, vol. 25, No, 2, pp. 137-140 (2003), with English abstract, Abstract only.
Umetani et al., "Prediction of Breast Tumor Progression by Integrity of Free Circulating DNA in Serum", Journal of Clinical Oncology, vol. 26, No. 26, pp. 4270-4276 (2006).
Wu et al., "Cell-free DNA: measurement in various carcinomas and establishment of normal reference range", *Clinica Chimica Acta*, vol. 321, pp. 77-87 (2002).
Fleischhacker et al., "Circulating nucleic acids (CNAS) and cancer—A survey", *Reviews on Cancer*, vol. 1775, No. 1, p. 181-232 (2006).
Tong et al., "Diagnostic developments involving cell-free (circulating) nucleic acids", *Clinica Chimica Acta*, vol. 363, pp. 187-196 (2006).
Chen, "Characterization of microRNAs in serum: a novel class of biomarkers for diagnosis of cancer and other diseases," *Cell Research*, 2008, vol. 18, pp. 997-1006.
Clarke et al., "Continuous base identification for single-molecule nanopore DNA sequencing," *Nature Nanotechnology*, Apr. 2009, vol. 4, pp. 265-270.
Goncalves, "Protein Profiling of Breast Tumor Cells and Subtypes," *Molecular & Cellular Proteomics*, 2008, vol. 7, pp. 1420-1433.
Lanza "mRNA/microRNA gene expression profile in microsatellite unstable colorectal cancer," *Molecular Cancer*, 2007, vol. 6(54), 11 pages.
Priness, "Evaluation of gene-expression clustering via mutual information distance measure," *BMC Bioinformatics*, 2007, vol. 8(111), 12 pages.
Wilting, "Integrated Genomic and Transcriptional Profiling Identifies Chromosomal Loci with Altered Gene Expression in Cervical Cancer," Genes, *Chromosomes & Cancer*, 2008, vol. 47, pp. 890-905.
Ardell, "SCANMS: adjusting for multiple comparisons in sliding window neutrality tests," *Bioinformatics*, 2004, vol. 20(12), pp. 1986-1988.
Yi et al., "Coupled analysis of gene expression and chromosomal location," *Genomics*, 2005, vol. 85, pp. 401-412.

* cited by examiner

Primary Examiner — Karen S. Weiler
(74) *Attorney, Agent, or Firm* — Kilpatrick, Townsend & Stockton LLP

(57) ABSTRACT

The invention provides methods and reagents for diagnosing breast cancer that are based on the detection of biomarkers in the circulating nucleic acids from a patient to be evaluated.

4 Claims, 1 Drawing Sheet

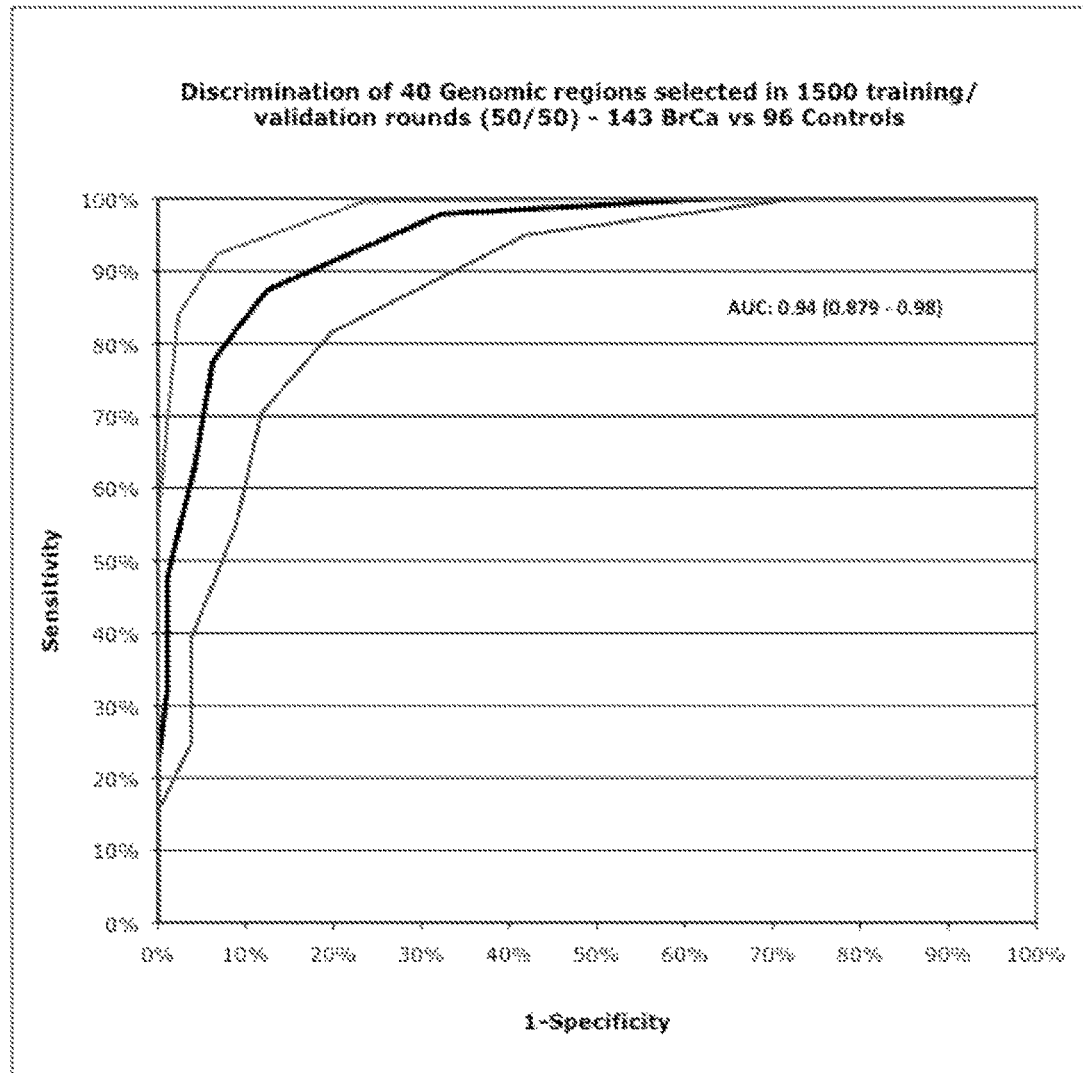

BREAST CANCER ASSOCIATED CIRCULATING NUCLEIC ACID BIOMARKERS

CROSS-REFERENCE TO RELATED APPLICATION

This application is a U.S. National Phase of PCT/US2011/032931, filed Apr. 18, 2011, which claims benefit of U.S. provisional application no. 61/324,927, filed Apr. 16, 2010, which applications are herein incorporated by reference in their entirety.

REFERENCE TO SEQUENCE LISTING

This application includes a Sequence Listing as a text file named "83443-001110US-854823_SEQLIST.txt" created Oct. 15, 2012, and containing 1,819,345 bytes. The material contained in this text file is incorporated by reference in its entirety for all purposes.

BACKGROUND OF THE INVENTION

Methods to detect breast cancer, including mammography, are well known in the art (see, e.g., Elmore, et al., *JAMA* 293:1245-56, 2005). However, there is a need for additional detection methods that can be used effectively and economically. This invention addresses that need.

BRIEF SUMMARY OF THE INVENTION

The invention is based, in part, on the discovery of circulating nucleic acids (CNA) biomarkers associated with breast cancer. The CNA biomarkers are nucleic acid sequences, in the current invention DNA sequences, i.e., DNA fragments, that are present in the blood, e.g., in a serum or plasma sample, of a breast cancer patient, but are rarely present, if at all, in the blood, e.g., a serum or plasma sample, obtained from a normal individual, i.e., in the context of this invention, an individual that does not have breast cancer.

Accordingly, in one aspect, the invention provides a method of analyzing CNA in a sample (blood, serum or plasma) from a patient comprising detecting the presence of at least one cell-free DNA having a nucleotide sequence falling within a chromosomal region set forth in Tables 2-8 (or having a nucleotide sequence that is a part of one of the sequences set forth in Tables of Sequences A-G) in said sample. In some embodiments, detecting the presence of, or the amount of, the at least one biomarker comprises detecting a cell-free DNA molecule having between 50 and 400 consecutive nucleotides of a unique sequence within a chromosomal region as set forth in Tables 2-8 (or of a unique sequence set forth in Tables of Sequences A-G).

In one embodiment, a method of analyzing circulating free DNA in a patient sample is provided, comprising determining, in a sample that is blood, serum or plasma, the presence or absence, or the amount of, at least 2, 3, 4, 5, 7, 8, 9, 10, 15, 20, 30 or at least 40 cell-free DNA molecules each having a sequence falling within a different chromosomal region set forth in Table 2, Table 3, Table 4, Table 5, Table 6, Table 7, or Table 8, and preferably the sequences of the cell-free DNA molecules are free of repetitive element. In preferred embodiments, the cell-free DNA molecules have sequences falling within different chromosomal regions in the same table that is chosen from Tables 2-8.

In another aspect, the present invention provides a kit including two or more (e.g., at least 2, 3, 4, 5, 6, 7, 8, 9, 10, 12, 15, 20, 25, 30 or at least 40, but less than 55 or 60) sets of oligonucleotides. Each set comprises one or more oligonucleotides with a nucleotide sequence falling within one single chromosomal region that is set forth in a table chosen from Tables 2-8. Preferably, different oligonucleotide sets correspond to different chromosomal regions within the same table. Also, preferably the oligonucleotides are free of repetitive element. Optionally, the oligonucleotides are attached to one or more solid substrates such as microchips and beads.

In another aspect, the present invention provides a method of diagnosing or screening for breast cancer in a patient. The method includes the steps of: (a) determining, in a sample that is blood, serum or plasma from a patient, the presence or absence or the amount of, at least 2, 3, 4, 5, 7, 8, 9, 10, 15, 20, 30 or at least 40 cell-free DNA molecules each having a sequence falling within a different chromosomal region set forth in Table 2, Table 3, Table 4, Table 5, Table 6, Table 7; and (b) correlating the presence of, or an increased amount of, said first and second cell-free DNAs with an increased likelihood that said patient has breast cancer. Preferably, the sequences of the cell-free DNA molecules are free of repetitive element. In preferred embodiments, the cell-free DNA molecules have sequences falling within different chromosomal regions in the same table that is chosen from Tables 2-8.

In one aspect, the invention provides a method of identifying a patient that has a CNA biomarker associated with breast cancer, the method comprising detecting the presence of at least one biomarker set forth in Table 2, 3, 4, 5, 6, or 7 in a CNA sample obtained from serum or plasma from the patient. In some embodiments, the invention provides a method of identifying a patient that has a CNA biomarker that is associated with the absence of breast cancer, the method comprising detecting the presence of at least one biomarker set forth in Table 8 in a CNA sample from serum or plasma from the patient. A biomarker can be identified using any number of methods, including sequencing of CNA as well as use of a probe or probe set to detect the presence of the biomarker.

In a further aspect, the invention provides a kit for identifying a patient that has a biomarker for breast cancer and/or that has a biomarker associated with a normal individual that does not have breast cancer, wherein the kit comprises at least one polynucleotide probe to a biomarker set forth in Table 2, 3, 4, 5, 6, 7, or 8. Preferably, such a kit comprises probes to multiple biomarkers, e.g., at least 2, 3, 4, 5, 10, 20, or 30, or more, of the biomarkers set forth in Table 2, Table 3, Table 4, Table 5, Table 6, Table 7, or Table 8. In some embodiments, the kit also includes an electronic device or computer software to compare the hybridization patterns of the CNA in the patient sample to a breast cancer data set comprising a listing of biomarkers that are present in breast cancer patient CNA, but not CNA samples from normal individuals.

In some embodiments, the presence of the at least one biomarker in CNA is determined by sequencing. In some embodiments, the presence of the at least one biomarker in CNA is determined using an array. In some embodiments, the presence of the at least one biomarker in CNA is determined using an assay that comprises an amplification reaction, such as a polymerase chain reaction (PCR). In some embodiments, a nucleic acid array forming a probe set comprising probes to two or more markers set forth in Table 2, 3, 4, 5, 6, 7, or 8 can be employed.

In an additional aspect, the invention provides a method of detecting breast cancer in a patient that has, or is suspected of having, breast cancer, the method comprising contacting DNA from the serum or plasma sample with a probe that selectively hybridizes to a sequence present on a chromosomal region described herein, e.g., a sequence set forth in Tables A-G under conditions in which the probe selectively hybridizes to the sequence; and detecting the presence or absence of hybridization of the probe, wherein the presence of hybridization is indicative of breast cancer.

The tables of sequences given in TABLES A-G provide examples of sequences corresponding to the chromosome regions set forth in Table 2-8, respectively. The designation (N)x in the tables refer to repetitive element sequences and define segments represented in the Sequence Listing as separate sequences. TABLE A =SEQ ID NOS:1-27, 28-67, 68-80, 81-107, 108-118, 119-131, 132-161, 162-204, 205-236, 237-273, 274-292, 293-337, 338-383, 384-408, 409-466, 467-484, 485-508, 509-526, 527-558, 559-578, 579-605, 606-653, 654-663, 664-686, 687-736, 737-763, 764-797, 798-823, 824-864, 865-888, 889-927, 928-975, respectively. TABLE B =SEQ ID NOS:976-1003, 1004-1022, 1023-1036, 1037-1049, 1050-1071, 1072-1104, 1105-1134, 1135-1161, 1162-1174, 1175-1205, 1206-1237, 1238-1274, 12751283, 1284-1302, 1303-1325, 1326-1348, 1349-1393, 1394-1400, 1401-1413, 1414-1434, 1435-1453, 1454-1493, 1494-1511, 1512-1544, 1545-1552, 1553-1577, 1578-1609, 1610-1645, 1646-1665, 1666-1692, 1693-1702, 1703-1725, 1726-1752, 1753-1787, 1788-1808, 1809-1832, 1833-1892, 1893-1941, respectively. TABLE C =SEQ ID NOS: 1942-1957, 1958-1961, 1962-1975, 1976-1989, 1990-2002, 2003-2013, 2014-2034, 2035-2052, 2053-2065, 2066-2076, 2077-2092, 2093-2109, 2110-2129, 2130-2146, 2147-2169, 2170-2185, 2186-2196, 2197-2218, 2219-2237, 2238-2243, 2244-2254, 2255-2275, 2276-2292, 2293-2308, 2309-2325, 2326-2331, 2332-2342, 2343-2353, 2354-2368, 2369-2381, respectively. TABLE D =SEQ ID NOS:2382-2385, 2386-2401, 2402-2415, 2416-2425, 2426-2440, 2441-2461, 2462-2471, 2472-2482, 2483-2491, 2492-2510, 2511-2533, 2534-2543, 2544-2552, 2553-2564, 2565-2581, 2582-2596, 2597-2602, 2603-2613, 2614-2635, 2636-2654, 2655-2660, 2661-2677, 2678-2688, 2689-2698, 2699-2709, 2710-2725, 2726-2743, respectively. TABLE E =SEQ ID NOS:2744-2750, 2751-2762, 2763-2768, 2769-2786, 2787, 2788-2796, 2797-2806, 2807-2813, 2814-2820, 2821-2836, 2837-2852, 2853-2854, 2855-2870, 2871-2889, 2890-2898, 2899-2913, 2914-2925, 2926, 2927-2935, 2936-2960, 2961-2972, 2973-2979, 2980-2995, 2996-3001, 3002-3018, respectively. TABLE F =SEQ ID NOS:3019-3069, respectively. TABLE G =SEQ ID NOS:3070-3076, respectively.

BRIEF DESCRIPTION OF THE DRAWINGS

FIG. 1 provides an example of a ROC curve using the 40 highest ranking regions of the chromosomal regions identified in Tables 7 and 8, collectively. The actual ROC curve-build from score sums is given together with the 95% confidence limits.

DETAILED DESCRIPTION OF THE INVENTION

As used herein, a "biomarker" refers to a nucleic acid sequence that corresponds to a chromosomal region, where the presence of the nucleic acid in CNA is associated with breast cancer; or in embodiments where the biomarker is set forth in Table 8, the absence of breast cancer.

In the current invention, a "chromosomal region" listed in any one of Tables 1 to 8 refers to the region of the chromosome that corresponds to the nucleotide positions indicated in the tables. The nucleotide positions on the chromosomes are numbered according to *Homo sapiens* (human) genome, build 37.2 as of November 2010 (Table 1-6) and *Homo sapiens* (human) genome, built 36 as of March 2006 (Table 7, 8). As understood in the art, there are naturally occurring polymorphisms in the genome of individuals. Thus, each chromosome regions listed in the table encompasses allelic variants as well as the particular sequence in the database, e.g., the sequences Tables A-G correspond to the chromosomal regions noted. An allelic variant typically has at least 95% identity, often at least 96%, at least 97%, at least 98%, or at least 99% identity to the sequence of a chromosomal region noted in the Tables that is present in a particular database, e.g., the National Center for Biotechnology Information (*Homo sapiens* Build 37.1 at the website http:// followed by www.ncbi.nlm.nih.gov/mapview/.) Percent identity can be determined using well known algorithms, including the BLAST algorithm, e.g., set to the default parameters. Further, it is understood that the nucleotide sequences of the chromosomes may be improved upon as errors in the current database are discovered and corrected. The term "chromosomal region" encompasses any variant or corrected version of the same region as defined in Tables 1-8. Given the information provided in the tables in the present disclosure, especially in view of the sequences listed in Tables A-G, a skilled person in the art will be able to understand the chromosomal regions used for the present invention even after new variants are discovered or error are corrected.

"Detecting the presence of a chromosomal region" in CNA in the context of this invention refers to detecting any sequence from a chromosomal region shown in Table 2, Table 3, Table 4, Table 5, Table 6, Table 7, or Table 8 where the sequence detected can be assigned unambiguously to that chromosomal region. Thus, this term refers to the detection of unique sequences from the chromosomal regions. Methods of removing repetitive sequences from the analysis are known in the art and include use of blocking DNA, e.g., when the target nucleic acids are identified by hybridization. In some embodiments, typically where the presence of a biomarker is determined by sequencing the CNA from a patient, well known computer programs and manipulations can be used to remove repetitive sequences from the analysis (see, e.g., the EXAMPLES section). In addition, sequences that have multiple equally fitting alignment to the reference database are typically omitted from further analyses.

The term "detecting a biomarker" as used herein refers to detecting a sequence from a chromosomal region listed in any of Tables 2-8. A biomarker is considered to be present if any nucleic acid sequence present in the CNA is unambiguously assigned to the chromosomal region.

The term "unambiguously assigned" in the context of this invention refers to determining that a DNA detected in the CNA of a patient is from a particular chromosomal region. Thus, in detection methods that employ hybridization, the probe hybridizes specifically to that region. In detection methods that employ amplification, the primer(s) hybridizes specifically to that region. In detection methods that employ sequencing, the sequence is assigned to that region based on well-known algorithms for identity, such as the BLAST algorithm using high stringent parameters, such as e<0.0001. In addition, such a sequence does not have a further equally fitting hit on the used database.

The term "circulating nucleic acids" refers to acellular nucleic acids that are present in the blood.

The term "circulating cell-free DNA" as used herein means free DNA molecules of 25 nucleotides or longer that are not contained within any intact cells in human blood, and can be obtained from human serum or plasma.

The term "hybridization" refers to the formation of a duplex structure by two single stranded nucleic acids due to complementary base pairing. Hybridization can occur between exactly complementary nucleic acid strands or between nucleic acid strands that contain minor regions of mismatch. As used herein, the term "substantially complementary" refers to sequences that are complementary except for minor regions of mismatch. Typically, the total number of mismatched nucleotides over a hybridizing region is not more than 3 nucleotides for sequences about 15 nucleotides in length. Conditions under which only exactly complementary nucleic acid strands will hybridize are referred to as "stringent" or "sequence-specific" hybridization conditions. Stable duplexes of substantially complementary nucleic acids can be achieved under less stringent hybridization conditions. Those skilled in the art of nucleic acid technology can determine duplex stability empirically considering a number of variables including, for example, the length and base pair concentration of the oligonucleotides, ionic strength, and incidence of mismatched base pairs. For example, computer software for calculating duplex stability is commercially available from National Biosciences, Inc. (Plymouth, Minn.); e.g., OLIGO version 5, or from DNA Software (Ann Arbor, Mich.), e.g., Visual OMP 6.

Stringent, sequence-specific hybridization conditions, under which an oligonucleotide will hybridize only to the target sequence, are well known in the art (see, e.g., the general references provided in the section on detecting polymorphisms in nucleic acid sequences). Stringent conditions are sequence-dependent and will be different in different circumstances. Generally, stringent conditions are selected to be about 5° C. lower to 5° C. higher than the thermal melting point (Tm) for the specific sequence at a defined ionic strength and pH. The Tm is the temperature (under defined ionic strength and pH) at which 50% of the duplex strands have dissociated. Relaxing the stringency of the hybridizing conditions will allow sequence mismatches to be tolerated; the degree of mismatch tolerated can be controlled by suitable adjustment of the hybridization conditions.

The term "primer" refers to an oligonucleotide that acts as a point of initiation of DNA synthesis under conditions in which synthesis of a primer extension product complementary to a nucleic acid strand is induced, i.e., in the presence of four different nucleoside triphosphates and an agent for polymerization (i.e., DNA polymerase or reverse transcriptase) in an appropriate buffer and at a suitable temperature. A primer is preferably a single-stranded oligodeoxyribonucleotide. The primer includes a "hybridizing region" exactly or substantially complementary to the target sequence, preferably about 15 to about 35 nucleotides in length. A primer oligonucleotide can either consist entirely of the hybridizing region or can contain additional features which allow for the detection, immobilization, or manipulation of the amplified product, but which do not alter the ability of the primer to serve as a starting reagent for DNA synthesis. For example, a nucleic acid sequence tail can be included at the 5' end of the primer that hybridizes to a capture oligonucleotide.

The term "probe" refers to an oligonucleotide that selectively hybridizes to a target nucleic acid under suitable conditions. A probe for detection of the biomarker sequences described herein can be any length, e.g., from 15-500 bp in length. Typically, in probe-based assays, hybridization probes that are less than 50 bp are preferred.

The term "target sequence" or "target region" refers to a region of a nucleic acid that is to be analyzed and comprises the polymorphic site of interest.

As used herein, the terms "nucleic acid," "polynucleotide" and "oligonucleotide" refer to primers, probes, and oligomer fragments. The terms are not limited by length and are generic to linear polymers of polydeoxyribonucleotides (containing 2-deoxy-D-ribose), polyribonucleotides (containing D-ribose), and any other N-glycoside of a purine or pyrimidine base, or modified purine or pyrimidine bases. These terms include double- and single-stranded DNA, as well as double- and single-stranded RNA. Oligonucleotides for use in the invention may be used as primers and/or probes.

A nucleic acid, polynucleotide or oligonucleotide can comprise phosphodiester linkages or modified linkages including, but not limited to phosphotriester, phosphoramidate, siloxane, carbonate, carboxymethylester, acetamidate, carbamate, thioether, bridged phosphoramidate, bridged methylene phosphonate, phosphorothioate, methylphosphonate, phosphorodithioate, bridged phosphorothioate or sulfone linkages, and combinations of such linkages.

A nucleic acid, polynucleotide or oligonucleotide can comprise the five biologically occurring bases (adenine, guanine, thymine, cytosine and uracil) and/or bases other than the five biologically occurring bases. These bases may serve a number of purposes, e.g., to stabilize or destabilize hybridization; to promote or inhibit probe degradation; or as attachment points for detectable moieties or quencher moieties. For example, a polynucleotide of the invention can contain one or more modified, non-standard, or derivatized base moieties, including, but not limited to, N6-methyladenine, N6-tert-butyl-benzyl-adenine, imidazole, substituted imidazoles, 5-fluorouracil, 5 bromouracil, 5-chlorouracil, 5-iodouracil, hypoxanthine, xanthine, 4-acetylcytosine, 5 (carboxyhydroxymethyl)uracil, 5 carboxymethylaminomethyl-2-thiouridine, 5 carboxymethylaminomethyluracil, dihydrouracil, beta-D-galactosylqueosine, inosine, N6 isopentenyladenine, 1-methylguanine, 1-methylinosine, 2,2-dimethylguanine, 2-methyladenine, 2-methylguanine, 3-methylcytosine, 5-methylcytosine, N6-methyladenine, 7-methylguanine, 5-methylaminomethyluracil, 5-methoxyaminomethyl-2-thiouracil, beta-D mannosylqueosine, 5'-methoxycarboxymethyluracil, 5-methoxyuracil, 2-methylthio-N-6-isopentenyladenine, uracil-5-oxyacetic acid (v), wybutoxosine, pseudouracil, queosine, 2 thiocytosine, 5-methyl-2-thiouracil, 2-thiouracil, 4-thiouracil, 5-methyluracil, uracil-5-oxyacetic acidmethylester, 3-(3-amino-3-N-2-carboxypropyl) uracil, (acp3) w, 2,6-diaminopurine, and 5-propynyl pyrimidine. Other examples of modified, non-standard, or derivatized base moieties may be found in U.S. Pat. Nos. 6,001,611; 5,955,589; 5,844,106; 5,789,562; 5,750,343; 5,728,525; and 5,679,785, each of which is incorporated herein by reference in its entirety. Furthermore, a nucleic acid, polynucleotide or oligonucleotide can comprise one or more modified sugar moieties including, but not limited to, arabinose, 2-fluoroarabinose, xylulose, and a hexose.

The term "repetitive element" as used herein refers to a stretch of DNA sequence of at least 25 nucleotides in length that is present in the human genome in at least 50 copies.

The terms "arrays," "microarrays," and "DNA chips" are used herein interchangeably to refer to an array of distinct polynucleotides affixed to a substrate, such as glass, plastic, paper, nylon or other type of membrane, filter, chip, bead, or any other suitable solid support. The polynucleotides can be synthesized directly on the substrate, or synthesized separate from the substrate and then affixed to the substrate. The arrays are prepared using known methods.

Introduction

The invention is based, at least in part, on the identification of CNA sequences from particular chromosomal regions that are present or at an increased amount in the blood of patients that have breast cancer, but are rarely, if ever, present, or at a lower amount, in the blood of normal patients that do not have breast cancer. The invention is also based, in part, on the identification of biomarkers in the CNA in normal individuals, i.e., in the context of this invention, individuals not diagnosed with breast cancer, that are rarely, if ever, present in patients with breast cancer. Thus, the invention provides methods and devices for analyzing for the presence of sequences from a chromosomal region corresponding to at least one of the chromosomal regions set forth in Table 2, Table, 3, Table 4, Table 5, Table 6, Table 7, or Table 8.

Accordingly, in one aspect, the invention provides a method of analyzing CNA in a sample (blood, serum or plasma) from a patient comprising detecting the presence of, or an amount of, at least one circulating cell-free DNA having a nucleotide sequence of at least 25 nucleotides falling within a chromosomal region set forth in Tables 2, 3, 4, 5, 6, 7 and 8 (or having a nucleotide sequence that is a part of one of the sequences set forth in Tables of Sequences A, B, C, D, E, F and G in the sample. Preferably, the circulating cell-free DNA is free of repetitive element. In one embodiment, the patient is an individual suspected of or diagnosed with cancer, e.g., breast cancer.

By "falling within" it is meant herein that the nucleotide sequence of a circulating cell-free DNA is substantially identical (e.g., greater than 95% identical) to a part of the nucleotide sequence of a chromosome region. In other words, the circulating cell-free DNA can hybridize to under stringent condition, or be derived from, the chromosomal region.

In one embodiment, a method of analyzing circulating cell-free DNA in a patient sample is provided, comprising determining, in a sample that is blood, serum or plasma, the presence or absence or the amount of, a plurality of circulating cell-free DNA molecules each having a sequence of at least 25 nucleotides in length falling within the same one single chromosomal region set forth in Table 2, Table 3, Table 4, Table 5, Table 6, Table 7, or Table 8 (or each having a nucleotide sequence of at least 25 consecutive nucleotides in length that is a part of the same sequence set forth in Tables of Sequences A, B, C, D, E, F and G). There may be two or more or any number of different circulating cell-free DNA molecules that are all derived from the same one chromosomal region set forth in Tables 2-8, and in some embodiments, all such circulating cell-free DNA molecules are detected and/or the amounts thereof are determined.

Preferably the sequences of the circulating cell-free DNA molecules are free of repetitive element.

In one embodiment, a method of analyzing circulating cell-free DNA in a patient sample is provided, comprising determining, in a sample that is blood, serum or plasma, the presence or absence or the amount of, at least 2, 3, 4, 5, 7, 8, 9, 10, 15, 20, 30 or at least 40 circulating cell-free DNA molecules each having a sequence of at least 25 base pairs falling within a different chromosomal region set forth in Table 2, Table 3, Table 4, Table 5, Table 6, Table 7, or Table 8 (or having a nucleotide sequence of at least 25, 40, 50, 60, 75 or 100 consecutive nucleotides in length that is a part of one of the sequences set forth in Tables of Sequences A, B, C, D, E, F and G). Preferably the sequences of the circulating cell-free DNA molecules are free of repetitive element. In preferred embodiments, the cell free DNA molecules have sequences falling within different chromosomal regions in the same table that is chosen from Tables 2-8. In one specific embodiment, the presence or absence or the amounts of, at least 2, 3, 4, 5, 7, 8, 9, 10, 15, 20, 30 or at least 32 circulating cell-free DNA molecules are determined the sequence of each falling within a different chromosomal region set forth in Table 2 (or having a nucleotide sequence of at least 25, 40, 50, 60, 75 or 100 consecutive nucleotides in length that is a part of one of the sequences set forth in Table of Sequences A). In another specific embodiment, the presence or absence or the amounts of, at least 2, 3, 4, 5, 7, 8, 9, 10, 15, 20, 30, 35, or at least 37 circulating cell-free DNA molecules are determined the sequence of each falling within a different chromosomal region set forth in Table 3 (or having a nucleotide sequence of at least 25, 40, 50, 60, 75 or 100 consecutive nucleotides in length that is a part of one of the sequences set forth in Table of Sequences B). In another specific embodiment, the presence or absence or the amounts of, at least 2, 3, 4, 5, 7, 8, 9, 10, 15, 20, 25, or at least 30 circulating cell-free DNA molecules are determined each having a sequence falling within a different chromosomal region set forth in Table 4 (or having a nucleotide sequence of at least 25, 40, 50, 60, 75 or 100 consecutive nucleotides in length that is a part of one of the sequences set forth in Table of Sequences C). In another specific embodiment, the presence or absence or the amounts of, at least 2, 3, 4, 5, 7, 8, 9, 10, 15, 20, 25, or at least 27 circulating cell-free DNA molecules are determined each having a sequence falling within a different chromosomal region set forth in Table 5 (or having a nucleotide sequence of at least 25, 40, 50, 60, 75 or 100 consecutive nucleotides in length that is a part of one of the sequences set forth in Table of Sequences D). In another specific embodiment, the presence or absence or the amounts of, at least 2, 3, 4, 5, 7, 8, 9, 10, 15, 20, or at least 25 circulating cell-free DNA molecules are determined each having a sequence falling within a different chromosomal region set forth in Table 6 (or having a nucleotide sequence of at least 25, 40, 50, 60, 75 or 100 consecutive nucleotides in length that is a part of one of the sequences set forth in Table of Sequences E). In another specific embodiment, the presence or absence or the amounts of, at least 2, 3, 4, 5, 7, 8, 9, 10, 15, 20, 30, 40, or at least 45 circulating cell-free DNA molecules are determined the sequence of each falling within a different chromosomal region set forth in Table 7 (or having a nucleotide sequence of at least 25, 40, 50, 60, 75 or 100 consecutive nucleotides in length that is a part of one of the sequences set forth in Table of Sequences F). In yet another specific embodiment, the presence or absence or the amounts of, at least 2, 3, 4, 5, 6, 7, or at least 8 circulating cell-free DNA molecules are determined each having a sequence falling within a different chromosomal region set forth in Table 8 (or having a nucleotide sequence of at least 25, 40, 50, 60, 75 or 100 consecutive nucleotides in length that is a part of one of the sequences set forth in Table of Sequences G).

In a specific embodiment, the method of analyzing circulating cell-free DNA includes the steps of: isolating, from blood, serum or plasma sample of a patient, substantially all circulating cell-free DNA molecules having a length of at least 20, 25, 30, 40, 50, 75 or 100 consecutive nucleotides in length, or between 50 and 400 nucleotides in length, obtaining the sequence of each of the circulating cell-free DNA molecules, and comparing the sequence to one or more of the sequences set forth in Tables of Sequences A-G) to determine whether the sequence falls within a chromosomal region set forth in Tables 2-8.

In another specific embodiment, the method of analyzing circulating cell-free DNA includes the steps of: isolating, from blood, serum or plasma sample of a patient, substantially all circulating cell-free DNA molecules having a length of at least 20, 25, 30, 40, 50, 75 or 100 consecutive nucleotides in length, or between 50 and 400 nucleotides in length, and contacting the circulating cell-free DNA molecules to a plurality of oligonucleotides (e.g., on a DNA chip or microarray) to determine if one of the circulating cell-free DNA molecules hybridizes to any one of the plurality of oligonucleotide probes under stringent conditions. Each of the oligonucleotide probes has a nucleotide sequence identical to a part of the sequence of a chromosomal region chosen from Tables 2-8 (or a sequence set forth in Tables of Sequences A-G). Thus, if a circulating DNA molecule hybridizes under stringent conditions to one of the oligonucleotide probes, it indicates that the circulating DNA molecule has a nucleotide sequence falling within a chromosomal region set forth in Tables 2-8.

In the above various embodiments, preferably the circulating cell-free DNA molecules have at least 25 consecutive nucleotides in length (preferably at least 50, 70, 80, 100, 120 or 200 consecutive nucleotides in length). More preferably, the circulating cell-free DNA molecules have between about 50 and about 300 or 400, preferably from about 75 and about 300 or 400, more preferably from about 100 to about 200 consecutive nucleotides of a unique sequence within a chromosomal region as set forth in Tables 2-8 (or of a unique sequence set forth in Tables of Sequences A-G).

In another aspect, the present invention provides a method of diagnosing or screening for breast cancer in a patient. The method includes the steps of: (a) determining, in a sample that is blood, serum or plasma from a patient, the presence or absence or the amount of, at least 1, 2, 3, 4, 5, 7, 8, 9, 10, 15, 20, 30 or at least 40 circulating cell-free DNA molecules each having a sequence of at least 25 nucleotides in length falling within a different chromosomal region set forth in Table 2, Table 3, Table 4, Table 5, Table 6, Table 7 (or having a nucleotide sequence of at least 25 consecutive nucleotides in length that is a part of one of the sequences set forth in Tables of Sequences A, B, C, D, E, F and G); and (b) correlating the presence of or an increased amount of the circulating cell-free DNAs with an increased likelihood that the patient has breast cancer.

Alternatively, the method of invention includes the steps of: (a) determining, in a sample that is blood, serum or plasma from a patient, the presence or absence or the amount of, at least 1, 2, 3, 4, 5, 7, or 8 circulating cell-free DNA molecules each having a sequence of at least 25 nucleotides in length falling within a different chromosomal region set forth in Table 8 (or having a nucleotide sequence of at least 25 consecutive nucleotides in length that is a part of one of the sequences set forth in Table of Sequences G); and (b) correlating the presence of or an increased amount of the circulating cell-free DNAs with a decreased likelihood that the patient has breast cancer.

When the steps of the above methods are applied to a patient diagnosed of cancer, the patient may be monitored for the status of breast cancer, or for determining the treatment effect of a particular treatment regimen, or detecting cancer recurrence or relapse.

In the diagnosis/monitoring method of the present invention, preferably the sequences of the circulating cell-free DNA molecules are free of repetitive element. In preferred embodiments, the cell free DNA molecules have sequences falling within different chromosomal regions in the same table that is chosen from Tables 2-8.

In one embodiment, a method of diagnosing breast cancer in an individual is provided, comprising (a) determining the presence or absence or the amounts of, at least 2, 3, 4, 5, 7, 8, 9, 10, 15, 20, 30 or at least 32 circulating cell-free DNA molecules the sequence of each falling within a different chromosomal region set forth in Table 2 (or having a nucleotide sequence of at least 25 consecutive nucleotides in length that is a part of one of the sequences set forth in Table of Sequences A); and (b) correlating the presence of or an increased amount of, one or more of the circulating cell-free DNA molecules with an increased likelihood that the individual has breast cancer or a recurrence of breast cancer or a failure of treatment for breast cancer.

In another embodiment, a method of diagnosing breast cancer in an individual is provided, comprising (a) determining the presence or absence or the amounts of, at least 2, 3, 4, 5, 7, 8, 9, 10, 15, 20, 30 or at least 37 circulating cell-free DNA molecules the sequence of each falling within a different chromosomal region set forth in Table 3 (or having a nucleotide sequence of at least 25 consecutive nucleotides in length that is a part of one of the sequences set forth in Table of Sequences B); and (b) correlating the presence of, or an increased amount of, one or more of the circulating cell-free DNA molecules with an increased likelihood that the individual has breast cancer or a recurrence of breast cancer or a failure of treatment for breast cancer.

In one embodiment, a method of diagnosing/monitoring breast cancer in an individual is provided, comprising (a) determining the presence or absence or the amounts of, at least 2, 3, 4, 5, 7, 8, 9, 10, 15, 20, 25, or at least 30 circulating cell-free DNA molecules the sequence of each falling within a different chromosomal region set forth in Table 4 (or having a nucleotide sequence of at least 25 consecutive nucleotides in length that is a part of one of the sequences set forth in Table of Sequences C); and (b) correlating the presence of, or an increased amount of, one or more of the circulating cell-free DNA molecules with an increased likelihood that the individual has breast cancer or a recurrence of breast cancer or a failure of treatment for breast cancer.

In one embodiment, a method of diagnosing/monitoring breast cancer in an individual is provided, comprising (a) determining the presence or absence or the amounts of, at least 2, 3, 4, 5, 7, 8, 9, 10, 15, 20, 25, or at least 27 circulating cell-free DNA molecules the sequence of each falling within a different chromosomal region set forth in Table 5 (or having a nucleotide sequence of at least 25 consecutive nucleotides in length that is a part of one of the sequences set forth in Table of Sequences D); and (b) correlating the presence of, or an increased amount of, one or more of the circulating cell-free DNA molecules with an increased likelihood that the individual has breast cancer or a recurrence of breast cancer or a failure of treatment for breast cancer.

In one embodiment, a method of diagnosing/monitoring breast cancer in an individual is provided, comprising (a) determining the presence or absence or the amounts of, at least 2, 3, 4, 5, 7, 8, 9, 10, 15, 20, or at least 25 circulating cell-free DNA molecules the sequence of each falling within a different chromosomal region set forth in Table 6 (or having a nucleotide sequence of at least 25 consecutive nucleotides in length that is a part of one of the sequences set forth in Table of Sequences E); and (b) correlating the presence of, or an increased amount of, one or more of the circulating cell-free DNA molecules with an increased likelihood that the individual has breast cancer or a recurrence of breast cancer or a failure of treatment for breast cancer.

In one embodiment, a method of diagnosing/monitoring breast cancer in an individual is provided, comprising (a) determining the presence or absence or the amounts of, at least 2, 3, 4, 5, 7, 8, 9, 10, 15, 20, 30, 40, or at least 45 circulating cell-free DNA molecules the sequence of each falling within a different chromosomal region set forth in Table 7 (or having a nucleotide sequence of at least 25 consecutive nucleotides in length that is a part of one of the sequences set forth in Table of Sequences F); and (b) correlating the presence of, or an increased amount of, one or more of the circulating cell-free DNA molecules with an increased likelihood that the individual has breast cancer or a recurrence of breast cancer or a failure of treatment for breast cancer.

In one embodiment, a method of diagnosing/monitoring breast cancer in an individual is provided, comprising (a) determining the presence or absence or the amounts of, at least 2, 3, 4, 5, 7, or at least 8 circulating cell-free DNA molecules the sequence of each falling within a different chromosomal region set forth in Table 8 (or having a nucleotide sequence of at least 25 consecutive nucleotides in length that is a part of one of the sequences set forth in Table of Sequences G); and (b) correlating the presence of or an increased amount of, one or more of the circulating cell-free DNA molecules with an increased likelihood that the individual does not have breast cancer or a recurrence of breast cancer or a failure of treatment for breast cancer.

In yet another embodiment, the method of diagnosing, monitoring or screening for breast cancer in a patient, includes determining, in a sample that is blood, serum or plasma from the patient, the presence or absence or the total amount of, each and all circulating cell-free DNAs each having a sequence falling within the same one single chromosomal region set forth in a table chosen from Tables 2-7; and correlating the presence of one of said circulating cell-free DNAs or an increased total amount of said circulating cell-free DNAs, with an increased likelihood that said patient has breast cancer, or recurrence of breast cancer. In other words, there can be any number of, and typically many, different circulating cell-free DNA molecules derived from one single same chromosomal region set forth in Tables 2-7, and all of such different circulating cell-free DNA molecules are detected and/or the amount each or all is determined, and correlation with the status of breast cancer is made.

In a specific embodiment, substantially all circulating cell-free DNA molecules having a length of at least 20, 25, 30, 40, 50, 75 or 100 consecutive nucleotides in length, or between 50 and 400 nucleotides in length, are isolated from a blood, serum or plasma sample of a patient. The sequence of each of the circulating cell-free DNA molecules is determined, and compared with one or more of the sequences set forth in Tables of Sequences A-G) to determine whether the sequence of a circulating cell-free DNA falls within a chromosomal region set forth in Tables 2-7. If so, a diagnosis of breast cancer is made. In the case of a patient treated with a therapy for breast cancer, recurrence is indicated if a circulating cell-free DNA falls within a chromosomal region set forth in Tables 2-8 is detected. In preferred embodiments, a diagnosis of breast cancer or breast cancer treatment failure or recurrence is indicated if two or more circulating cell-free DNA molecules fall within 2, 3, 4 or more chromosomal regions set forth in Tables 2-8, preferably all such chromosomal regions being in the same table.

In another specific embodiment, substantially all circulating cell-free DNA molecules having a length of at least 20, 25, 30, 40, 50, 75 or 100 consecutive nucleotides in length, or between 50 and 400 nucleotides in length, are isolated from a blood, serum or plasma sample of a patient. These circulating cell-free DNA molecules are hybridized to a microarray that is described above in the context of the kit invention to determine if one of the circulating cell-free DNA molecules hybridizes to any one of a plurality of oligonucleotide probes under stringent conditions. Each of the oligonucleotide probes has a nucleotide sequence identical to a part of the sequence of a chromosomal region chosen from Tables 2-8 (or a sequence set forth in Tables of Sequences A-G). Thus, if a circulating DNA molecule hybridizes under stringent conditions to one of the oligonucleotide probes, it indicates that the circulating DNA molecule has a nucleotide sequence falling within a chromosomal region set forth in Tables 2-7. If so, a diagnosis of breast cancer is made. In the case of a patient treated with a therapy for breast cancer, recurrence is indicated if a circulating cell-free DNA falls within a chromosomal region set forth in Tables 2-7 is detected. In preferred embodiments, a diagnosis of breast cancer or breast cancer treatment failure or recurrence is indicated if two or more circulating cell-free DNA molecules fall within 2, 3, 4 or more chromosomal regions set forth in Tables 2-7, preferably all such chromosomal regions being in the same table, e.g., Table 2, 3, 4, 5, 6, 7.

In the above various embodiments, preferably the circulating cell-free DNA molecules have at least 25 consecutive nucleotides in length (preferably at least 50, 70, 80, 100, 120 or 200 consecutive nucleotides in length). More preferably, the circulating cell-free DNA molecules have between about 50 and about 300 or 400, preferably from about 75 and about 300 or 400, more preferably from about 100 to about 200 consecutive nucleotides of a unique sequence within a chromosomal region as set forth in Tables 2-8 (or of a unique sequence set forth in Tables of Sequences A-G).

Detection of Circulating Nucleic Acids in the Blood

In order to detect the presence of circulating nucleic acids in the blood of patients that may have, or are suspected of having, breast cancer, a blood sample is obtained from the patient. Serum or plasma from the blood sample is then analyzed for the presence of a circulating cell-free DNA or biomarker as described herein. Nucleic acids can be isolated from serum or plasma using well known techniques, see, e.g., the example sections. In the context of the current invention, the nucleic acid sequences that are analyzed are DNA sequences. Thus, in this section, methods described as evaluating "nucleic acids" refers to the evaluation of DNA.

Detection techniques for evaluating nucleic acids for the presence of a biomarker involve procedures well known in the field of molecular genetics. Further, many of the methods involve amplification of nucleic acids. Ample guidance for performing is provided in the art. Exemplary references include manuals such as PCR Technology: *Principles and Applications for DNA Amplification* (ed. H. A. Erlich, Freeman Press, NY, N.Y., 1992); *PCR Protocols: A Guide to Methods and Applications* (eds. Innis, et al., Academic Press, San Diego, Calif., 1990); Current Protocols in Molecular Biology, Ausubel, 1994-1999, including supplemental updates through April 2004; Sambrook & Russell, *Molecular Cloning, A Laboratory Manual* (3rd Ed, 2001).

Although the methods may employ PCR steps, other amplification protocols may also be used. Suitable amplification methods include ligase chain reaction (see, e.g., Wu & Wallace, *Genomics* 4:560-569, 1988); strand displacement assay (see, e.g., Walker et al., *Proc. Natl. Acad. Sci. USA* 89:392-396, 1992; U.S. Pat. No. 5,455,166); and several transcription-based amplification systems, including the methods described in U.S. Pat. Nos. 5,437,990; 5,409,818; and 5,399,491; the transcription amplification system (TAS) (Kwoh et al., *Proc. Natl. Acad. Sci. USA* 86:1173-1177, 1989); and self-sustained sequence replication (3SR) (Guatelli et al., *Proc. Natl. Acad. Sci. USA* 87:1874-1878, 1990; WO 92/08800). Alternatively, methods that amplify the probe to detectable levels can be used, such as Qβ-replicase amplification (Kramer & Lizardi, *Nature* 339:401-402, 1989; Lomeli et al., *Clin. Chem.* 35:1826-1831, 1989). A review of known amplification methods is provided, for example, by Abramson and Myers in *Current Opinion in Biotechnology* 4:41-47, 1993.

In some embodiments, the detection of biomarker in the CNA of a patient is performed using oligonucleotide primers and/or probes to detect a target sequence, wherein the target sequence is present in (e.g., comprises some unambiguously assigned portion of) any of the chromosomal regions listed in Table 2, Table 3, Table 4, Table 5, Table 6, Table 7, or Table 8. Oligonucleotides can be prepared by any suitable method, usually chemical synthesis, and can also be purchased through commercial sources. Oligonucleotides can include modified phosphodiester linkages (e.g., phosphorothioate, methylphosphonates, phosphoamidate, or boranophosphate) or linkages other than a phosphorous acid derivative into an oligonucleotide may be used to prevent cleavage at a selected site. In addition, the use of 2'-amino modified sugars tends to favor displacement over digestion of the oligonucleotide when hybridized to a nucleic acid that is also the template for synthesis of a new nucleic acid strand.

In one embodiment, the biomarker is identified by hybridization under sequence-specific hybridization conditions with a probe that targets a chromosomal region described herein. The probe used for this analysis can be a long probe or sets for short oligonculeotide probes, e.g., from about 20 to about 150 nucleotides in length may be employed.

Suitable hybridization formats are well known in the art, including but not limited to, solution phase, solid phase, oligonucleotide array formats, mixed phase, or in situ hybridization assays. In solution (or liquid) phase hybridizations, both the target nucleic acid and the probe or primers are free to interact in the reaction mixture. Techniques such as real-time PCR systems have also been developed that permit analysis, e.g., quantification, of amplified products during a PCR reaction. In this type of reaction, hybridization with a specific oligonucleotide probe occurs during the amplification program to identify the presence of a target nucleic acid. Hybridization of oligonucleotide probes ensure the highest specificity due to thermodynamically controlled two state transition. Examples for this assay formats are fluorescence resonance energy transfer hybridization probes, molecular beacons, molecular scorpions, and exonuclease hybridization probes (e.g., reviewed in Bustin, *J. Mol. Endocrin.* 25:169-93, 2000).

Suitable assay formats include array-based formats, described in greater detail below in the "Device" section, where probe is typically immobilized. Alternatively, the target may be immobilized.

In a format where the target is immobilized, amplified target DNA is immobilized on a solid support and the target complex is incubated with the probe under suitable hybridization conditions, unhybridized probe is removed by washing under suitably stringent conditions, and the solid support is monitored for the presence of bound probe. In formats where the probes are immobilized on a solid support, the target DNA is typically labeled, usually during amplification. The immobilized probe is incubated with the amplified target DNA under suitable hybridization conditions, unhybridized target DNA is removed by washing under suitably stringent conditions, and the solid support/probe is monitored for the presence of bound target DNA.

In typical embodiments, multiple probes are immobilized on a solid support and the target chromosomal regions in the CNA from a patient are analyzed using the multiple probes simultaneously. Examples of nucleic acid arrays are described by WO 95/11995.

In an alternative probe-less method, amplified nucleic acid corresponding to a target nucleic acid present in a chromosomal region is performed using nucleic acid primers to the chromosomal region and is detected by monitoring the increase in the total amount of double-stranded DNA in the reaction mixture, is described, e.g., in U.S. Pat. No. 5,994,056; and European Patent Publication Nos. 487,218 and 512,334. The detection of double-stranded target DNA relies on the increased fluorescence various DNA-binding dyes, e.g., SYBR Green, exhibit when bound to double-stranded DNA.

As appreciated by one in the art, specific amplification methods can be performed in reaction that employ multiple primers to target the chromosomal regions such that the biomarker can be adequately covered.

DNA Sequencing

In preferred embodiments, the presence of a sequence from a chromosomal region set forth in Table 2, Table 3, Table 4, Table 5, Table 6, Table 7, or Table 8 in the CNA from a patient undergoing evaluation is detected by direct sequencing. Such sequencing, especially using the Roche 454, Illumina, and Applied Biosystems sequencing systems mentioned below or similar advanced sequencing systems, can include quantitation (i.e., determining the level) of nucleic acids having a particular sequence. Such quantitation can be used in the embodiments of the invention that involve determining the level of a biomarker (some embodiments of which involve correlating a particular level to the presence or absence of cancer). Methods include e.g., dideoxy sequencing-based methods although other methods such as Maxam and Gilbert sequencing are also known (see, e.g., Sambrook and Russell, supra). In typical embodiments, CNA from a patient is sequenced using a large-scale sequencing method that provides the ability to obtain sequence information from many reads. Such sequencing platforms includes those commercialized by Roche 454 Life Sciences (GS systems), Illumina (e.g., HiSeq, MiSeq) and Applied Biosystems (e.g., SOLiD systems).

The Roche 454 Life Sciences sequencing platform involves using emulsion PCR and immobilizing DNA fragments onto bead. Incorporation of nucleotides during synthesis is detected by measuring light that is generated when a nucleotide is incorporated.

The Illumina technology involves the attachment of randomly fragmented genomic DNA to a planar, optically transparent surface. Attached DNA fragments are extended and bridge amplified to create an ultra-high density sequencing flow cell with clusters containing copies of the same template. These templates are sequenced using a sequencing-by-synthesis technology that employs reversible terminators with removable fluorescent dyes.

Methods that employ sequencing by hybridization may also be used. Such methods, e.g., used in the ABI SOLiD4+ technology uses a pool of all possible oligonucleotides of a fixed length, labeled according to the sequenced position. Oligonucleotides are annealed and ligated; the preferential ligation by DNA ligase for matching sequences results in a signal informative of the nucleotide at that position.

The sequence can be determined using any other DNA sequencing method including, e.g., methods that use semiconductor technology to detect nucleotides that are incorporated into an extended primer by measuring changes in current that occur when a nucleotide is incorporated (see, e.g., U.S. Patent Application Publication Nos. 20090127589 and 20100035252). Other techniques include direct label-free exonuclease sequencing in which nucleotides cleaved from the nucleic acid are detected by passing through a nanopore (Oxford Nanopore) (Clark et al., *Nature Nanotechnology* 4: 265-270, 2009); and Single Molecule Real Time (SMRT™) DNA sequencing technology (Pacific Biosciences), which is a sequencing-by synthesis technique.

Devices and Kits

In a further aspect, the invention provides diagnostic devices and kits useful for identifying one or more breast cancer-associated biomarkers in the CNA from a patient where the one or more biomarkers is a sequence corresponding to any of the chromosomal regions set forth in Table 2, Table, 3, Table 4, Table 5, Table 6, Table 7, or Table 8. As will be apparent to skilled artisans, the kit of the present invention is useful in the above-discussed method for analyzing circulating cell-free DNA in a patient sample and in diagnosing, screening or monitoring breast cancer as described above.

Thus, in one aspect, the present invention provides the use of at least one oligonucleotide for the manufacture of a diagnostic kit useful in diagnosing, screening or monitoring breast cancer. The nucleotide sequence of the oligonucleotide falls within a chromosomal region set forth in Tables 2, 3, 4, 5, 6, 7 and 8 (or matches a part of a sequence set forth in Tables of Sequences A, B, C, D, E, F and G).

Preferably, the kit of the present invention includes one, two or more (e.g., at least 1, 2, 3, 4, 5, 6, 7, 8, 9, 10, 12, 15, 20, 25, 30 or at least 40, but preferably less than 60, preferably from one to about 50, more preferably from 2 to about or 3 to about 50) sets of oligonucleotides. Each set comprises one or more oligonucleotides (e.g., from about one to about 10,000, preferably from 50, 100, 200 or 300 to about 10,000). All of the nucleotide sequences of such one or more oligonucleotides in each set fall within the same one single chromosomal region that is set forth in a table chosen from Tables 2, 3, 4, 5, 6, 7 or 8 (or match a part of the same one single sequence set forth in Tables of Sequences A, B, C, D, E, F or G). Each oligonucleotide should have from about 18 to 100 nucleotides, or from 20 to about 50 nucleotides, and is capable of hybridizing, under stringent hybridization conditions, to the chromosomal region in which its sequence falls. The oligonucleotides are useful as probes for detecting circulating cell-free DNA molecules derived from the chromosomal regions. Preferably, each set includes a sufficient number of oligonucleotides with sequences mapped to one chromosomal region such that any circulating cell-free DNA molecules derived from the chromosomal region can be detected with the oligonucleotide set. Thus, the number of oligonucleotides required in each set is determined by the total length of unique nucleotide sequence of a particular chromosomal region, as will be apparent to skilled artisans. Such total lengths are indicated in Tables 2-8 and should also be apparent from Tables of Sequences A, B, C, D, E, F and G.

Preferably, in the kit of the present invention, different oligonucleotide sets correspond to different chromosomal regions within the same table. Preferably, the oligonucleotides are free of repetitive element. Optionally, the oligonucleotides are attached to one or more solid substrates such as microchips and beads. In preferred embodiments, the kit is a microarray with the above oligonucleotides.

In one embodiment, the kit of the present invention includes a plurality of oligonucleotide sets capable of hybridizing to the chromosomal regions set forth in Tables 2, 3, 4, 5, 6, 7 and 8, respectively. That is, the kit includes oligonucleotide probes corresponding to each and every chromosomal regions set forth in Tables 2, 3, 4, 5, 6, 7 and 8 (or matching each and every sequence set forth in Tables of Sequences A, B, C, D, E, F or G) such that all circulating cell-free DNA derived from any chromosomal region set forth in Tables 2-8 can be detected using the kit.

Use of the oligonucleotides included in the kit described for the manufacture of the kit useful for diagnosing, screening or monitoring breast cancer is also contemplated. The manufacturing of such kit should be apparent to a skilled artisan.

In some embodiments, a diagnostic device comprises probes to detect at least 2, 3, 4, 5, 6, 7, 8, 9, 10, 15, 20, or 50, or at least 100 the chromosomal regions set forth in Tables 2-8. In some embodiments, the present invention provides probes attached to a solid support, such as an array slide or chip, e.g., as described in DNA Microarrays: A Molecular Cloning Manual, 2003, Eds. Bowtell and Sambrook, Cold Spring Harbor Laboratory Press. Construction of such devices are well known in the art, for example as described in US Patents and Patent Publications U.S. Pat. No. 5,837,832; PCT application WO95/11995; U.S. Pat. No. 5,807,522; U.S. Pat. Nos. 7,157,229, 7,083,975, 6,444,175, 6,375,903, 6,315,958, 6,295,153, and 5,143,854, 2007/0037274, 2007/0140906, 2004/0126757, 2004/0110212, 2004/0110211, 2003/0143550, 2003/0003032, and 2002/0041420. Nucleic acid arrays are also reviewed in the following references: *Biotechnol Annu Rev* 8:85-101 (2002); Sosnowski et al, *Psychiatr Genet.* 12(4):181-92 (December 2002); Heller, *Annu Rev Biomed Eng* 4: 129-53 (2002); Kolchinsky et al, *Hum. Mutat* 19(4):343-60 (April 2002); and McGail et al, Adv Biochem Eng Biotechnol 77:21-42 (2002).

Any number of probes may be implemented in an array. A probe set that hybridizes to different, preferably unique, segments of a chromosomal region may be used where the probe set detects any part of the chromosomal region. Alternatively, a single probe to a chromosomal region may be immobilized to a solid surface. Polynucleotide probe can be synthesized at designated areas (or synthesized separately and then affixed to designated areas) on a substrate, e.g., using a light-directed chemical process. Typical synthetic polynucleotides can be about 15-200 nucleotides in length.

The kit can include multiple biomarker detection reagents, or one or more biomarker detection reagents in combination with one or more other types of elements or components (e.g., other types of biochemical reagents, containers, packages such as packaging intended for commercial sale, substrates to which biomarker detection reagents are attached, electronic hardware components, etc.). Accordingly, the present invention further provides biomarker detection kits and systems, including but not limited to arrays/microarrays of nucleic acid molecules, and beads that contain one or more probes or other detection reagents for detecting one or more biomarkers of the present invention. The kits can optionally include various electronic hardware components; for example, arrays ("DNA chips") and microfluidic systems ("lab-on-a-chip" systems) provided by various manufacturers typically comprise hardware components. Other kits may not include electronic hardware components, but may be comprised of, for example, one or more biomarker detection reagents (along with, optionally, other biochemical reagents) packaged in one or more containers.

Biomarker detection kits/systems may contain, for example, one or more probes, or sets of probes, that hybridize to a nucleic acid molecule present in a chromosomal region set forth in Tables 2-8.

A biomarker detection kit of the present invention may include components that are used to prepare CNA from a blood sample from a patient for the subsequent amplification and/or detection of a biomarker.

Correlating the Presence of Biomarkers with Breast Cancer

The present invention provides methods and reagents for detecting the presence of a biomarker in CNA from a patient that has breast cancer or that is being evaluated to determine if the patient may have breast cancer. In the context of the invention, "detection" or "identification" or "identifying the presence" or "detecting the presence" of a biomarker associated with the presence or absence of breast cancer in a CNA sample from a patient refers to determining any level of the biomarker in the CNA of the patient where the level is greater than a threshold value that distinguishes between breast cancer and non-breast cancer CNA samples for a given assay.

In the current invention, for example, the presence of any one of the biomarkers listed in Tables 2-7 is indicative of breast cancer. As appreciated by one of skill in the art, biomarkers may be employed in analyzing a patient sample where the biomarker has also been observed infrequently in a normal patient to in order to increase the sensitivity of the detection. For example, the biomarkers indicated by bold font in Tables 3 and 4 have been observed to be present infrequently in CNA obtained from normal individuals; however, given the low frequency of occurrence in normal samples relative to the higher frequency of occurrence in breast cancer, the presence of the biomarker in a patient indicates that the patient has a 90% or greater likelihood of having breast cancer. Thus, for example, arrays used to detect the chromosomal regions can include those that identify the chromosomal regions in Tables 3 and 4 that are indicated in bold font.

The biomarkers set forth in Tables 1-7 are associated with breast cancer, i.e., they are over-represented in breast cancer patients compared to individuals not diagnosed with breast cancer. Thus, the detection of one or more of the biomarkers set forth in Tables 1-7 is indicative of breast cancer, i.e., the patient has an increased probability of having breast cancer compared to a patient that does not have the biomarker. In some embodiments, the detection of two or more biomarkers set forth in Tables 1-7 in the CNA of a patient is indicative of a greater probability for breast cancer. As understood in the art, other criteria, e.g., clinical criteria, mammography, etc., are also employed to diagnose breast cancer in the patient. Accordingly, patients that have a biomarker associated with breast cancer also undergo other diagnostic procedures.

In some embodiments, one or more biomarkers that are under-represented in breast cancer may be detected in the CNA of a patient. Thus, for example, a biomarker listed in Table 8 may be detected in a CNA sample from a patient where the detection of the biomarker is indicative of a normal diagnosis, i.e., that the patient does not have breast cancer.

"Over-represented" or "increased amount" means that the level of one or more circulating cell-free DNAs is higher than normal levels. Generally this means an increase in the level as compared to an index value. Conversely "under-represented" or "decreased amount" means that the level of one or more particular circulating cell-free DNA molecules is lower than normal levels. Generally this means a decrease in the level as compared to an index value.

In preferred embodiments, the test value representing the amount of a particular circulating cell-free DNA is compared to one or more reference values (or index values), and optionally correlated to breast cancer or cancer recurrence. Optionally, an increased likelihood of breast cancer is indicated if the test value is greater than the reference value.

Those skilled in the art are familiar with various ways of deriving and using index values. For example, the index value may represent the copy number or concentration of a particular cell-free DNA according to the present invention in a blood sample from a patient of interest in healthy state, in which case a copy number or concentration in a sample from the patient at a different time or state significantly higher (e.g., 1.5-fold, 2-fold, 3-fold, 4-fold, 5-fold, 10-fold, 20-fold, 30-fold, 40-fold, 50-fold, 100-fold or more higher) than this index value would indicate, e.g., breast cancer or increased likelihood of cancer recurrence.

Alternatively, the index value may represent the average concentration or copy number of a particular circulating cell-free DNA for a set of individuals from a diverse cancer population or a subset of the population. For example, one may determine the average copy number or concentration of a circulating cell-free DNA in a random sampling of patients with breast cancer. Thus, patients having a copy number or concentration (test value) comparable to or higher than, this value identified as having an increased likelihood of having breast cancer or breast cancer recurrence than those having a test value lower than this value.

Often the copy number or amount (e.g., concentration) will be considered "increased" or "decreased" only if it differs significantly from the index value, e.g., at least 1.5 fold difference in absolute or relative (e.g., as reflected by hybridization signal) copy number or concentration.

A useful index value may represent the copy number or concentration of a particular circulating cell-free DNA or of a combination (weighted or straight addition) of two or more circulating cell-free DNAs corresponding to the same chromosomal region or different chromosomal regions. When two or more biomarkers or circulating cell-free DNA molecules are used in the diagnosis/monitoring method, the presence or absence of, or the amount of, each biomarker or circulating cell-free DNA can be weighted and combined. Thus, a test value may be provided by (a) weighting the determined status or amount of each circulating cell-free DNA molecule with a predefined coefficient, and (b) combining the weighted status or amount to provide a test value. The combining step can be either by straight addition or averaging (i.e., weighted eaqually) or by a different predefined coefficient.

The information obtained from the biomarker analysis may be stored in a computer readable form. Such a computer system typically comprises major subsystems such as a central processor, a system memory (typically RAM), an input/output (I/O) controller, an external device such as a display screen via a display adapter, serial ports, a keyboard, a fixed disk drive via a storage interface and a floppy disk drive operative to receive a floppy disc, and a CD-ROM (or DVD-ROM) device operative to receive a CD-ROM. Many other devices can be connected, such as a network interface connected via a serial port.

The computer system may also be linked to a network, comprising a plurality of computing devices linked via a data link, such as an Ethernet cable (coax or 10BaseT), telephone line, ISDN line, wireless network, optical fiber, or other suitable signal transmission medium, whereby at least one network device (e.g., computer, disk array, etc.) comprises a pattern of magnetic domains (e.g., magnetic disk) and/or charge domains (e.g., an array of DRAM cells) composing a bit pattern encoding data acquired from an assay of the invention.

The computer system can comprise code for interpreting the results of a study evaluating the presence of one or more of the biomarkers. Thus in an exemplary embodiment, the biomarker analysis results are provided to a computer where a central processor executes a computer program for determining the likelihood of a patient that has breast cancer.

The invention also provides the use of a computer system, such as that described above, which comprises: (1) a computer; (2) a stored bit pattern encoding the biomarker testing results obtained by the methods of the invention, which may be stored in the computer; (3) and, optionally, (4) a program for determining the likelihood of a patient having breast cancer.

The invention further provides methods of generating a report based on the detection of one or more biomarkers set forth in Tables 2-8.

Thus, the present invention provides systems related to the above methods of the invention. In one embodiment the invention provides a system for analyzing circulating cell-free DNA, comprising: (1) a sample analyzer for executing the method of analyzing circulating cell-free DNA in a patient's blood, serum or plasma as described in the various embodiments above (incorporated herein by reference); (2) a computer system for automatically receiving and analyzing data obtained in step (1) to provide a test value representing the status (presence or absence or amount, i.e., concentration or copy number) of one or more circulating cell-free DNA molecules having a nucleotide sequence of at least 25 nucleotides falling within a chromosomal region set forth in Tables 2, 3, 4, 5, 6, 7 and 8 (or having a nucleotide sequence that is a part of one of the sequences set forth in Tables of Sequences A, B, C, D, E, F and G), and optionally for comparing the test value to one or more reference values each associated with a predetermined status of breast cancer. In some embodiments, the system further comprises a display module displaying the comparison between the test value and the one or more reference values, or displaying a result of the comparing step.

Thus, as will be apparent to skilled artisans, the sample analyzer may be, e.g., a sequencing machine (e.g., Illumina HiSeq™, Ion Torrent PGM, ABI SOLiD™ sequencer, PacBio RS, Helicos Heliscope™, etc.), a PCR machine (e.g., ABI 7900, Fluidigm BioMark™, etc.), a microarray instrument, etc.

In one embodiment, the sample analyzer is a sequencing instrument, e.g., a next-generation sequencing instrument such as Roche's GS systems, Illumina's HiSeq and MiSeq, and Life Technologies' SOLiD systems. Circulating cell-free DNA molecules are isolated from a patient's blood or serum or plasma, and the sequences of all of the circulating cell-free DNA molecules are obtained using the sample analyzer. The sequencing instrument is used in sequencing the circulating cell-free DNA molecules, and obtaining the sequences of these molecules. A computer system is then employed for automatically analyzing the sequences to determine the presence or absence or amount of a circulating cell-free DNA molecule having a nucleotide sequence of at least 25 nucleotides falling within a chromosomal region set forth in Tables 2, 3, 4, 5, 6, 7 and 8 (or having a nucleotide sequence that is a part of one of the sequences set forth in Tables of Sequences A, B, C, D, E, F and G) in the sample. For example, the computer system may compare the sequence of each circulating cell-free DNA molecule in the sample to each sequence in Tables of Sequences A, B, C, D, E, F and G to determine if there is a match, i.e., if the sequence of a circulating cell-free DNA molecule falls within a sequence in Tables of Sequences A, B, C, D, E, F and G, or within a chromosomal region set forth in Tables 2, 3, 4, 5, 6, 7 and 8. The copy number of a particular circulating cell-free DNA molecule is also automatically determined by the computer system. Optionally the computer system automatically correlates the sequence analysis result with a diagnosis regarding breast cancer. For example, if one, two or more circulating cell-free DNA molecules are identified to be derived from a chromosomal region in Tables 2-7, and preferably two or more circulating cell-free DNA molecules with sequences falling within different chromosomal regions within one single table chosen from Tables 2-7, then the computer system automatically correlates this analysis result with a diagnosis of breast cancer. Optionally, the computer system further comprises a display module displaying the results of sequence analysis and/or the result of the correlating step. The display module may be for example, a display screen, such as a computer monitor, TV monitor, or the touch screen, a printer, and audio speakers.

The computer-based analysis function can be implemented in any suitable language and/or browsers. For example, it may be implemented with C language and preferably using object-oriented high-level programming languages such as Visual Basic, SmallTalk, C++, and the like. The application can be written to suit environments such as the Microsoft Windows™ environment including Windows™ 98, Windows™ 2000, Windows™ NT, and the like. In addition, the application can also be written for the MacIntosh™, SUN™, UNIX or LINUX environment. In addition, the functional steps can also be implemented using a universal or platform-independent programming language. Examples of such multi-platform programming languages include, but are not limited to, hypertext markup language (HTML), JAVA™, JavaScript™, Flash programming language, common gateway interface/structured query language (CGI/SQL), practical extraction report language (PERL), AppleScript™ and other system script languages, programming language/structured query language (PL/SQL), and the like. Java™- or JavaScript™-enabled browsers such as HotJava™, Microsoft™ Explorer™, or Netscape™ can be used. When active content web pages are used, they may include Java™ applets or ActiveX™ controls or other active content technologies.

The analysis function can also be embodied in computer program products and used in the systems described above or other computer- or internet-based systems. Accordingly, another aspect of the present invention relates to a computer program product comprising a computer-usable medium having computer-readable program codes or instructions embodied thereon for enabling a processor to carry out the analysis and correlating functions as described above. These computer program instructions may be loaded onto a computer or other programmable apparatus to produce a machine, such that the instructions which execute on the computer or other programmable apparatus create means for implementing the functions or steps described above. These computer program instructions may also be stored in a computer-readable memory or medium that can direct a computer or other programmable apparatus to function in a particular manner, such that the instructions stored in the computer-readable memory or medium produce an article of manufacture including instruction means which implement the analysis. The computer program instructions may also be loaded onto a computer or other programmable apparatus to cause a series of operational steps to be performed on the computer or other programmable apparatus to produce a computer implemented process such that the instructions which execute on the computer or other programmable apparatus provide steps for implementing the functions or steps described above.

The following examples are provided by way of illustration only and not by way of limitation. Those of skill in the art will readily recognize a variety of non-critical parameters that could be changed or modified to yield essentially similar results.

EXAMPLES

Example 1

Identification of Breast Cancer-Associated Biomarker in CNA

Sequencing of CNA:

After extraction of DNA from serum or plasma, using standard silica based methods, a whole genome amplification was performed in duplicate. The products were pooled and used for further analysis.

Long Sequencing Runs:

The primer sequences for 454 sequencing were added to the product using fusion primers in not more than 20 cycles of PCR. The resulting product was treated according to the 454 sequencer manual and used for direct sequence detection.

High Density Short Tag Runs:

The whole genome amplification product was digested with NlaIII endonuclease and ligated to artificial linkers harbouring a EcoP15I restriction recognition site. After digestion and re-ligation the resulting linkered di-tags were re-amplified, followed by digestion with NlaIII and concatemerization of the linker-free di-tags. Sequencing primers with identifiers are ligated in the same step and the resulting product consisting of up to 20 sequence tags of about 26 bp in length was subjected to 454 sequencing according to the manufacturer's manual.

Computational Analysis:

Sequences with Reads Longer than 40 bp

The sequence reads were appointed to the sample source by reading the identifier sequence string and all non source parts were cut out (e.g. primers).

The origin of the circulating DNA was investigated by local alignment analyses using the BLAST program using high stringent parameters (30). Repetitive elements were detected and masked by using a local install of the Repeatmasker software package (31) using the repbase (version 12.09) that was obtained from the Genetic Information Research Institute (32). After masking of the repetitive elements and region of low sequence complexity each sequence was subjected to sequential BLAST analyses querying databases of bacterial, viral and fungal genomes and the human genome (reference genome build 37.1). Bacterial, viral, fungal and human genomes were obtained from the National Center for Biotechnology Information (NCBI, (ftp-.ncbi.nih.gov)). After each of the sequential database searches all parts of a queried sequence that produced significant hits (e<0.0001) were masked and masked sequences were subsequently used to query the next database. Masked nucleotides were counted and subtracted from the total nucleotide counts resulting in the amounts of unidentified nucleotides.

For each query fragment and each database search, the highest scoring BLAST hit with a length of more than 50% of the query sequence was recorded in a SQL database. The highest scoring BLAST hit was defined as the longest hit with the highest percent identity (maximum of hit length× identity). For each of the sequences, the start and stop positions for query and database were recorded.

Short Sequence Tags:

After identifying the sample source as given above, the sequences were first dissected at each NlaIII restriction recognition side into di-tags. These are cut into tags by using the following algorithm: If ditag-length is even use length/2 bases from the left and right side of ditag to generate tags. If ditag-length is odd use integer(length/2) number of bases from right and left side of ditag to generate tags.

The genomic origin of the tags was investigated by local alignment analyses using the BLAST program using high stringent parameters. Closely comparable result can be achieved using other alignment programs such as BowTie. For each query fragment and each database search, the highest scoring alignment hit with a) no mismatch if tag length is <21 or b) not more than one mismatch if tag length is 21 or higher, and only one such a hit exists the tag position on the respective genome database as recorded in a SQL database. This also serves as an example for sequencing that generated short sequence tags per se such as SOLiD™ (Applied Biosystems/Life Tech.) or Solexa (Illumina Inc.).

Disease Association Analysis:

To investigate which sequences/sequence tags are disease associated, all alignments that could be unambiguously placed on the human genomic database (*Homo sapiens* Build 37.1 at the website http www address ncbi.nlm.nih-.gov/mapview/) were used. Those were categorized into 4060 region of 750,000 bp intervals and selected for differences between normal controls and cancer patients on the basis of a group comparison using the non-parametric median test. Five hundred chromosomal regions having the lowest p-values were used for further analyses.

In 335 rounds of bootstrap random selected samples linear multivariate regressions modeling was performed using the above selected 750 k regions as independent parameters. The MVRs were calculated based on Akaike's Information criterion (AIC), using about 90,000,000 models (2 to 5 parameters). The independent parameters were ranked according to the Akaike weight sums of the bootstrap approach (using a subset of samples) and the best 42 are given (Table 1).

The highest ranking thirty two 750 k regions were then applied to the total group of cancer (n=178) and normal controls (n=108) and the slope estimates were re-adjusted.

The performance calculations showed a sensitivity of 79% and a specificity of 97%.

Selection of Clusters in the Pre-selected Regions

As a second step, a cluster search within the 42 regions (31.5 million bp) was performed and 58 clusters of cancer samples were found without any normal sample reducing the size to 1.6 million base pairs. The cluster regions were restricted to those 32 that had a distance to the next normal hit of at least 200 bp. These regions provide a 89% sensitivity with 100% true negative classification, where a sample is called positive if at least one hit is found in any of the cluster regions (see Table 2).

In a further analysis, additional clusters were searched where only one or less normal sample was found in a cluster of at least 10 cancer samples. A total of 81 clusters were found (24 with one normal 57 without normals). By applying the same rules as above (at least 200 bp from the next hit), using 37 of those yielded 94% true positives and 95% true negatives. The total length was calculated to be 672 kbp (see Table3). Use of the 32 regions without any false positives, which are bolded in Table 3, provides an 87% sensitivity and 100% specificity.

Selection of Genomic Clusters

As a third step, a search for genomic clusters was performed over the whole non-repetitive genome. A selection of 30 clusters covering 301 kbp was sufficient to give a rate of 93% true positives at a 97% true negative level (see Table 4). Excluding those three regions (bolded in Table 4) that had one hit in normal, non-breast cancer patients, the true positive rate was 88% and 100% specificity.

One further search was for the best cluster combination, where no false positive results were tolerated per se. Table 5 shows biomarkers of 27 clusters with a total length of 260 kbp where the sensitivity was 90% with no false positive detected.

Using a selection of 56 BrCa sera and 35 normals the above described short sequence tag study was performed. By doing so, the hit count per sample was increased by about 11-fold and the same approach as shown above for long sequences was used to define hotspot clusters. By using 17 regions, spanning about 122 kbp, 55|56 BrCa patients are correctly classified, which calculates to 98%, when all controls were correctly classified (see Table 6). If a sample is only designated positive when at least two distinct hits are found per sample and no hits are detected in a normal sample, the sensitivity is 94.6% and 96.4% if 8 additional (total 25) chromosomal regions are considered. The latter still yields a sensitivity of 91% if the delimiter is set to three hits, but still no single hit of any normal sample.

Example 2

Identification of Additional Biomarkers that are Over- or Under-Represented in Breast Cancer In a further analysis to identify biomarkers, a subset of 143 BrCa samples and 96 Controls were sequenced on a Life Technologies SOLiD4+ System, which is a high-throughput sequencer that typically can run hundreds of millions of sequences of lengths of about 30 to about 75 bases in parallel. (Another example of such a sequencing technology is the Genome Analyzer (Illumina)). Briefly, samples were prepared as described for the 454 sequencing (0051 & 0052), where adaptors specific to SOLiD4+ sequencing are used. For each sample around 5 million reads of 40 bp were obtained and aligned to the Human genome (Build Hg18) using the Life Technologies "Bioscope" software suite with default stringency values. All uniquely aligned reads were used for further analysis.

In order to define the chromosomal regions, where samples of either group cluster in comparison the second group, all hits were ranked in order of their appearance on the chromosomes. Biomarker regions were initially defined as those regions where at least 15 hits covering at least 10 samples of a group were counted, but not more than one sample of the other group demonstrated a hit.

In 1500 rounds of random re-sampling the samples were divided into a training and validation set of 50% of each group. For each region, a sample in the region was assigned a score of 1 if the cluster was a breast cancer (BrCa) cluster and a score of −1 for a region where normal samples cluster. The average AUC for the validation set was found to be 0.88 if the score sums of 42 cluster regions were used. The regions used in the 1500 rounds of re-sampling were ranked according to the number of round in which either region participated. Table 7 and Table 8 show the 56 highest ranking regions. Table 7 summarizes those clusters overrepresented in breast cancer serum samples. Table 8 summarizes those that are underrepresented in breast cancer serum samples. These regions were used in a final calculation on all samples; the ROC curve using the 40 highest ranking regions is shown in FIG. 1 (95% confidence limit). The AUC was calculated to be 0.94 (95% confidence interval: 0.87-0.98). The maximal accuracy was 87% (81%-93%) at the maximal Youden Index, representing a score sum of 1 as delimiter. The respective sensitivity was 87% (82%-92%), the specificity was 88% (80%-93%).

All patents, patent applications, sequence accession numbers, and other published reference materials cited in this specification are hereby incorporated herein by reference in their entirety for their disclosures of the subject matter in whose connection they are cited herein.

Lengthy table referenced here

US10047397-20180814-T00001

Please refer to the end of the specification for access instructions.

Lengthy table referenced here

US10047397-20180814-T00002

Please refer to the end of the specification for access instructions.

Lengthy table referenced here

US10047397-20180814-T00003

Please refer to the end of the specification for access instructions.

Lengthy table referenced here

US10047397-20180814-T00004

Please refer to the end of the specification for access instructions.

Lengthy table referenced here
US10047397-20180814-T00005

Please refer to the end of the specification for access instructions.

Lengthy table referenced here
US10047397-20180814-T00006

Please refer to the end of the specification for access instructions.

Lengthy table referenced here
US10047397-20180814-T00007

Please refer to the end of the specification for access instructions.

Lengthy table referenced here
US10047397-20180814-T00008

Please refer to the end of the specification for access instructions.

Lengthy table referenced here
US10047397-20180814-T00009

Please refer to the end of the specification for access instructions.

Lengthy table referenced here
US10047397-20180814-T00010

Please refer to the end of the specification for access instructions.

Lengthy table referenced here
US10047397-20180814-T00011

Please refer to the end of the specification for access instructions.

Lengthy table referenced here
US10047397-20180814-T00012

Please refer to the end of the specification for access instructions.

Lengthy table referenced here
US10047397-20180814-T00013

Please refer to the end of the specification for access instructions.

Lengthy table referenced here
US10047397-20180814-T00014

Please refer to the end of the specification for access instructions.

Lengthy table referenced here
US10047397-20180814-T00015

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US10047397B2). An electronic copy of the table will also be available from the USPTO upon request and payment of the fee set forth in 37 CFR 1.19(b)(3).

SEQUENCE LISTING (3076 sequences)

SEQ ID NO: 1 - DNA, 302 bp, Homo sapiens
ttgggcaaggctaaaaagcccatctgtggcctgtgtgggcctcagtttccctgggtgtgtaatgagggagctgggtttcacattgccaagttcccttccaactgtctatgactcttcagccgccatgagtctgattcttcttattgtcacgtcagggcagaccagaacacactgaccaagcctcgtagacacatagcagggatgattctaaactcagaggaacattgtctagaagccacaggtgcaccacattagtgtaccaaggcttgcccttctctctgcagcctggagagtttttaagg

SEQ ID NO: 2 - DNA, 1048 bp, Homo sapiens
aaagcctagagagttttaacgctttctcccctctggctcttccctaagcttctctctgattttccacctctatgcccctgcggcctcctgcacctccggcccgtcccctcactgtccttacctggttataggtgcagttcttcttcttgcatttgctgcactggaagaggtcagtggtggtgccgccagtcttggccatctggtgctcacggatggcctcctgggtcatggcattcctcaactccctcagttcatcactggccatttcctggagaaaaaagagtctacccttcagggctgaggagtttcaggggccctgccctacacccggtttctagaaagcctgaacagaaaaggaggtaacatgctttattgactgcaaggagctggaaggaggcctggattccgggtcctgccccagctgggagaaagctgtccccgcagagtcctcctgccgcccacggctggaaggtcataatgcacattcaggtgagcagcaggcaaacagcctctgcccgaggacgagcactcctgtgtacatttcttcagatctggggctcatcctgcctgccaggaccttggccttggcctgaaccttcctgcttgagctgacttgatcactgccacctggtctatgatgttccccttagccttcctctctagacttgacccagtgctcttttacgctgtgatcactgccctgctgttctgcttagtgggaaccttggcgcaactacccatgacttgctgctgctacccccatcctgaagctcctgggctcacacaactaactgttcatctgatgagcatgcatccaagatcatctttttctgagagtttctacagaagagtctccagtctcccaccagctcacagtagacactccgggtctgcatcacccacacctttgctttctctgtccatctccctggccacttgtctccccttaagcctctgccagaggacagcagagagggagctccagttaagggttggtggaaggggaaggagggtggctgacgcgaatctcaaaatgaggattttaaac

SEQ ID NO: 3 - DNA, 136 bp, Homo sapiens
taaacattttaattgttgctgtctgtcctgagtccttaaaccatggagaagaatgctggcataaaggtcaaagcattttagtgtgctcacctttcattataaccacttaggcttcttgataaaatgcagattccta

SEQ ID NO: 4 - DNA, 223 bp, Homo sapiens
agaatatgcattttcactagtgtcctcaagttattctggtacgtattaatgtttaagtcctagtgtgttaaattcaaaggctaggccctaaccaatggcaggagaatatagaaaaacaagtcaatgaaagccatttacccatatgagtaaaaagtagctgactttaatttgaggggattttccagagcataaagcatttgcccattcaaaatttattggatgt

SEQ ID NO: 5 - DNA, 74 bp, Homo sapiens
tctattggatgccaatttactgaatgcctttaactgtatcagtttgcaggtaaaccagctttggttgtggggat

SEQ ID NO: 6 - DNA, 280 bp, Homo sapiens
cagaggacaagaatagcatgtttggggaaaagtatttggggtaggttcaagtcaagcatgggagatgtggctggaggtcagattgtggaaggaaggtcttgtgtgccagctaagaaatagagaacagaaaaatctatccagccacacgccaattcattgacttctctgccctgcctcattagaatgaggcagcatcagagacacggagaataaatacaacactgtagaaaataaggtggaaaatgaaggaaatgagagtcagagaccacaattctatccc

SEQ ID NO: 7 - DNA, 289 bp, Homo sapiens
tggactgtgaatgccggttctcaggggactgacaggatgctatgtccactcagcagcgctcatgggtatctcagagcctactccattctttgctatgtctgagtagggaagaaaagagaagaagaaagaatgagggagtcaggtaaacaaggaaagaggcataaaaagggagtcagggaagggagttctgagagagacaccgtccacatgggttcctgatgggcgcttcccctcacagcaggcagcccaagcccaagctaagatttttctgtttttttttctttttttc

SEQ ID NO: 8 - DNA, 153 bp, Homo sapiens
cactgtaaagccaagttgcaatttataactccaggcatatgttgctatttacccaaaaagatcagatattttaaattaggcagaaagataaccctggtctacctgtgccaagttccccatttcatcctaaagccaaggctctttgctgtttgt

SEQ ID NO: 9 - DNA, 93 bp, Homo sapiens
acacagacacacacttccacatgccacacatacacaaaccacacatgccacacatatgctaatcacacaccacacacatacttcacatgacat

SEQ ID NO: 10 - DNA, 51 bp, Homo sapiens
tccatacatcatacacacatattccacacatcatacacgccacatacactc

SEQ ID NO: 11 - DNA, 56 bp, Homo sapiens
tccacatatcatacatgccacacacatatactatacaccaaacacacctcacacat

SEQ ID NO: 12 - DNA, 121 bp, Homo sapiens
tgcccactgctcacctcctgttgtgtggcctggttcccaacaggtaccagctggtggcctgagggttagggatccctaatatataccatacgcacatgctccatacatacacacacataca

SEQ ID NO: 13 - DNA, 28 bp, Homo sapiens
gcccccacacatgccacacaacctagcg

SEQ ID NO: 14 - DNA, 542 bp, Homo sapiens
tcctgctagtccagagcccaggggggaggctgagatgaggctggtttgaaaagctccctggctcactgctgatgagtcacgagccactgaccctctgcactaggcagggctagggggacctggcttcctgcctcaccatgcagatgccctgctctcacctctgccgtcatcttggctataagccctgcggagatggccccactgagcacgttccgccgcaggccggggttcctggggtccttgaggttgcttatgcggctgcgcacgcggttccggtacttcatgtccgtgctcttgagctcttggtagatatgtgacacagtcaagggccggccagccattcatggaggggcacagaagggtgcaggcctggccctgacgcctgagagctccagaaccctttcttcctctcctcggacttctacaggagttgggcccctcttttgtgacctctgactctccaagtggtgatgtctcttgggcatttgtggtcagccaagtagcagagaaagaaaatagcttctggggtaagatcagatcat

SEQ ID NO: 15 - DNA, 183 bp, Homo sapiens
ctgtgagctaagccacgtgatgcactagtgtggtgtctgggatatatcaaatgctcaacatgtatgggctgctaagatgatgacaaggatgcggataacttctagtttggaagggcccctggaggttgtgagtccagctgtcagaggaaaagattaagagccacatgtttaaggctctacgaa

SEQ ID NO: 16 - DNA, 25 bp, Homo sapiens
ccacgctgggaattgctggtcagag

SEQ ID NO: 17 - DNA, 695 bp, Homo sapiens
cggcaggaagtcatccctggccaccaaccacagagtttctgtccaaacactgcatcctaggcaggcttccgagcctcccactccctccaccctctggaggagctcggggaacacagcctcattttcttggtctcctgagccaaagaagatcaggaagacaaagctgttgctgggaagagccatatacaataaagagactgcggagaatgtggaaaaatgaaaacagatgacttgctagaagtggtgggaggggaggtggtattctttcttttttctgttattgttttaatgttgtttgtacaataaaagtgtgaaaagcaaagaatatgccacaatgcatgtgaaagccaaaaaatgtgttttaaaatgtaccacttgggattcctggggtgtattgatatgcggagccagcagggctggcgatactttcaccagcctctttctgactctgtctccatgtcccaaggccacagaggggacgaggcagagagcagaccgggggcaccggcccctcagaggaacttttggctgcattgttagcacagggccactccaaagaggacagatctattttaggacatagagcagtcaagcccccaaatgtaccctccccctgacctccagctggctaaaaacaaagagctaaagtgtttgatgcagctttgatttcctctcctttagaagagggacattca

SEQ ID NO: 18 - DNA, 724 bp, Homo sapiens
ggaactttcagtggatggaggaaaggctgggagtggaactttgtactggaccatctgctgttgtttcaaactgggcttaaaggtggaaaggacctgcttggagggatgactgttcaggagaaaatgaagatgaaactcgtgatagttctcataccttgtgttctgccttcttgaattaacaggaaatgatgaaaatgtactttttgaggtgctgaatggctccagacttgttgaggtattgctgattaatcattaaatgagagtagagagaaaccaccagaaaataagttggagggaatcagggtaggccacaggaagaagatggaaacgcaaatttgtcgtctgcagattggcccctggctctcctcaacagaccctgctgaactccgcaggtagaacccaggagccctcaaaagggtcgctcacacctcggtgtgacacttagacttcctgtcccctgactgtctccccgctccaataccatgcaaacctttgtctctagtaaaagaagctccatgttttcattcagtgggggccaagtggggtgggattttttttctcccaagccaaacaccttttggtgcaacagatctatgaatacatcccagtggtggccacctctcctgtctacacaaggcccctttcaggtgagaagttggggagcagggggcacatggaaaggattcaatacatggaatccaaagacaaagtctccagtcccgct

SEQ ID NO: 19 - DNA, 128 bp, Homo sapiens
gggcgctgttaacatcagaggatgggagaagggaaaaggctgagcatgggaaatgctgacctctcaatctagtctgttcctggaagtaacgacttggccaactgaggcacgctattacacagcctagc

SEQ ID NO: 20 - DNA, 571 bp, Homo sapiens
atagaattaagaactctggttcaggggcagagcaggggctgttcccggagcccttcctctccttcctcactctcccagctcgcttgcaccttggatgggtgctgctagacggtgcagacacccacagccccggcacagttcaaggatatgatcttcgatttctgatgccatcttgtcacagttgactccatagtccttgtaatcatctaaaagagattcgagaaatacaggtatcagccagacacaacgtaggcagtgaagcctgcttgtacctgggactagagtgttcctgtaccatcccttggggtgctgagaaagactgaatttcatctgccctcagtgagattgggaaaagggactccttccctccctcatccctagcccaggctctctcaccgtccgccttcagggctgctgacagcatctccacacacttgtcccggacagagtcccctgtgagatagcagggggccaggagacacatggaagaggcaaacgtgggggtcaaggggctgctaggtgttttggggctctccgcttttgatttgctgctgtttgatctgaggatgac

SEQ ID NO: 21 - DNA, 123 bp, Homo sapiens
ttaaccagccactgtgcgttactcattatagaacagtgtaacaccaccaataattatatgcaattgattaggcactgtgctagctgctctctatctatgctctcctaaatgtatgaactgttt

SEQ ID NO: 22 - DNA, 59 bp, Homo sapiens
aacacctatgctataatctatgatgtactatctaagaattatctcattcaggttttgtt

SEQ ID NO: 23 - DNA, 44 bp, Homo sapiens
ccatatgtgcacagacatttagaaggctaactatgtggctcaat

SEQ ID NO: 24 - DNA, 204 bp, Homo sapiens
aaaaaaatgcattcttggcagaaatgatggaagtgtagaaggccaaggtttgcatgggcaatgtcaaagggctcaatgcagctggagcgtgagggtgagggagcttgtaagaaggagagggagttggagagaaaggatctaaccagactctggggtttgttaaggatggtaaaacaaaagccaccatttaccactgctctgctg

SEQ ID NO: 25 - DNA, 81 bp, Homo sapiens
ctcctgcctcagcctcccaagtagctaggactgactacaggcagatgccgccacaccaggctttttttttttttttgtaga

SEQ ID NO: 26 - DNA, 287 bp, Homo sapiens
gcaagactttgtgatagttgcacaactccctccctcccaagatgtttttgcactattctttagggtaggagccaggaagtcaggaagtctctgtcttcattcctctgctcttctcacctcctttttcaataacccatcagaatctgccagccagcccctatatctctgttgagaaaaaagtggactcatcagagttgaaaaaattaaggtcccctcctggagtgaaattaagacccactcgagggtcttaccaaactgagcccttgtggaagcgcccagagagctgc

SEQ ID NO: 27 - DNA, 771 bp, Homo sapiens
gggcctggatccacagctgcttctcatgttcactttcaggctgtggacatgctacttcctttcaggaagaagaggattctggacttctgacaaagtctctcaggcccagggagttgtgtctgagagtgaggctaactgagtagcccaggcttctcaggatcaacaacctggagttaccagagaatcccatccaacatcctgctgggcacagctcagtgtggactctgctggtgacctccctgtcccccacctcttgctgtttggcctgaccttggatctcctctttcaccccagacccctggacctttgggatttttgcattctctagagacttgaggttcctcaaaagtgcctccatgcataccggtgaggtgggctggggatggtaaactctgttcttgtaaggtttacattttgaatttctaaaaattttgtccaaagggattcatttcctagcttttatttatttttaatgcagtttgaaacttactgtcctagattaatctagccttaattctacccgaccctgcctgacaactgggttgcctggcagcatggtggagggacagggaagctgagatccaagcagatttctcctggagtcagattgcagcaggaggtttgggtgaggaaaggctggacagggcgtgaactcgcggggctgttggcatccaaaacggatgttcctgcccccaagcctgatcctggtcacagggttcccacctgaacagtcacaatagccccaaaactggtttccctgtgtcctcttcc

SEQ ID NO: 28 - DNA, 100 bp, Homo sapiens
ccccagatcagtgtgtgtcccacttacttgtgggtaggagcatcctagcgattgtgttacatggtaggttctgagccagtgagtcggggtggtatctgag

SEQ ID NO: 29 - DNA, 156 bp, Homo sapiens
ctcctctgcaactcacggatcacaccagcctccacctcattatttcaacggagccttgaattgctatctccttctactaatgctcaggattggggatggatggaggcaagccttctagatcttcttctgtagcccccatagccaaaaatctgagtg

SEQ ID NO: 30 - DNA, 175 bp, Homo sapiens
attgatctgggacccaggtctttttcattgcacttggctgtttggttaatcttctctgtggctcagaactggcagcccgcttcttggacacagactgcctgttgacaatgtaccacatacggtctttagagccccctgtgctatgtcctctggtctccacaatcccaggaggcag

SEQ ID NO: 31 - DNA, 24 bp, Homo sapiens
gttcggcttcctacaatgactcgg

SEQ ID NO: 32 - DNA, 101 bp, Homo sapiens
ttttttgtttgtttgtttgtttgtttgtttttgagacaaggtctcactaacactacctaacactaatcagtctatgggcaaagactgtgtcttattcaggt

SEQ ID NO: 33 - DNA, 258 bp, Homo sapiens
tcctgggttctgcagtccttgcccccaggacaccaccccctccctgagaaccactcccttgctcctagcccagttctgaaggcagccatttttcactgcagagaccagccctgcccctcccgaatttaactagacgggaacccacagcgtgtcatacagcacagtggccccaggatggcagtagatgcccatgtgtaagatctctggcccagcctgagcctcctttaaagggtaatttacttgcatgtgtctcttcct

SEQ ID NO: 34 - DNA, 88 bp, Homo sapiens
attaccatgagtctcattggcctctcctcctgggagaaactaattgtcctcaccctctgcatcaggacctttaagaaagaagaatgtg

SEQ ID NO: 35 - DNA, 46 bp, Homo sapiens
gaggttgaaaagatatcaaatcaaaggcaaattaaactttaaaaag

SEQ ID NO: 36 - DNA, 112 bp, Homo sapiens
ctttacaaaggaaaatgttcctcctaaaggatatatgaagatacttagcattttcagcagtcaggctttgattgattcattgattcatccattcactcacttacccactgag

SEQ ID NO: 37 - DNA, 76 bp, Homo sapiens
tggtggtggcttggacctcagcagggacagtgggaaagtgtcagattctggatatacagttgtccctctgtctcca

SEQ ID NO: 38 - DNA, 1294 bp, Homo sapiens
gagagatgtgggcattaagtgaaggcaaataccacaaagtcattaagtgtgggctcagaaaagcctttactggagaaacgcacaaacagagggtggaagccgaatgaggcattgagttgttcaaccgctcatcattgtttggagagaggtagagggaaccagggcacagcaggagacaccgtggagtgtgctccagaaggggaaccccaccttgctagctactctactttttgtataggcaattgtgaggttagtcttgtaagtaaagaaaaacaggtccaagcttagactctaggggaattgcttacagtgctgaggacacctggagcccctgtgggatgtagaggccaggtagagtcatttctgcttttgggaaaggcgccctctctggaatccatctgctatctgtttgctaggagcctggagtgagcccccaggggcttcctatacagtgcaacttggttttccaaggttcatccccttatctacgggctcatcaaacatgggactcaccaaatataagcatgcccaacaggagtagaaatcaattgggcttataatgggatttccagtgattgttggcaatgctggaggagacactgcagaaggagggaggcctggagtcatagtacaaacccaccatggaggcctgaggcacctggacatggagaccatgtgaagtctgaggaaagagcccaaggctcagacagaggagtagcctggagccatgaggcatgttcccgtggtagctttgggcttctggacttagccaaaggtattcatccagaaacagcagaggatattgtccagtgaagctagctactctcctggctggccaaaaagagtgcaaagctatgtggttatcccgcatgacctgagttcatgataacctcgccagtgagaaccttggctgtccctgtggcaattcccttcaggatacctgagcccctgtggattgtagattctacctataataggaggaaaatctgcataaaatggtgaaatctatgtactgaatacccaggaatgtcttgtcaaaagcactagaggctgggactgggaacactgctgtgcccacaggtcttgggttatcatgagggctcatatgcaggtggtattctttccaaacagaaagcaaggaaggacctatatccagagtacaaatcaagtcctgggggatacacaggactgctcaatattctgccagttcacctccacaccttccatgcaggggatgggaacatggttgtgccatttgtagctgtggcctgatttctcccaactaaattccccc

SEQ ID NO: 39 - DNA, 582 bp, Homo sapiens
ccctaaagcacagcagtttttggcaatggccagctaggagcaattcccttgccatggtcagagagggagacaccaacaaggtctcccatagctgggtatggaggacaggggtagtggtggtgatacgttcaatactgtaggtttgtggaatggagcctggcctaggcagctgctagaggctgttgaagctttttctgtctgaacctggaagagcaggtgagaggttatttactcttcgaccctgatctgtttcctgatatcgcttgcgtatgttcttgctacatcagctgaggcttgtcatgtccccagaatcagccaaacgatctgtactttttcttagagcattgacctcacaggaacccagcagtcactattctgccctcaaaggcaatcccttgagactgaggatggtggttgcagagcagaaggaacctgttgcacaggcatagtgaccacagcaatgttctccatttgcagaggagatggatggtaggaacactgccttcctctaggtaaaggcagtgtcagagttgcctgcccagggtgtgtgtccatcaagtgcccttcaaaaaaggaaaaaaa

SEQ ID NO: 40 - DNA, 382 bp, Homo sapiens
aaagacccaaagtcatgtccacccagttagcctcaactagagcaatgtgaacttaccagccaatggtcaaagttcttgctcaaaaaagaaggggcagttagggacagagattctggggtcctggcacattgagtagactcttccccatcccatgtgcctgcaaagaatgatgaagtagtggctgatatagctgctcccgtaaccagccatactaaagcttgattctacccgccacctgcaagtggaaaggagaattccatgttgaaatggaattcagggcccaaagctgtaaacagcattctattgtcagcttgtgtcataccaggaaactctaacacatgacaaagataatcatcacagtcttaagagtttgggtgctatc

SEQ ID NO: 41 - DNA, 599 bp, Homo sapiens
gagtttggatgctatctgcttgttggaaaagaacaacagccacttatatatctatagcatgcccatggtaatcagaatacattgtaaccaactatcaattgtgaattggtcagacaacaagttattatgcctagttcactttgagccataggccaatgttgctggcaagtaatacactctccatgagcaccagcatcttcttcataggtcaaatgaatccttattgggtcacctcagacctccatggagatttggctattacagtagatccaagcacggatctagtgcaccaaaggggatgtgacgccccatcatcttgatcagctttttcattccagatgctctcttcgagatgcagtgccttattgtggcttgtgtatatgtcacatgcagattgagtttgtggttgaattgctgcatttgtttccgtggcagggattaccatataaataactggggtctgtcatgtccccggggatcagtcaatgatctgtaaaggaaacctgaaagaggagaatcatgtagagggaggctccctgggacccaaccagcccaaaacttgcctaaggtgagcccacaggaggaagctgggggagtaa

SEQ ID NO: 42 - DNA, 94 bp, Homo sapiens
ggaccagagctaccaagttaggggcgactgaggacagtttacaggaagtggtcttagctggtttttctttttctttttttttttcctgatagga

SEQ ID NO: 43 - DNA, 85 bp, Homo sapiens
aacaaagtaggatataggagaatcatcataaaatgaaaggggtgagaaaatgtctggacacgtaagacactgataagcaatcata

SEQ ID NO: 44 - DNA, 252 bp, Homo sapiens
cccagcagactgtgaaacattctattgtagaactacacataaaatgtggaaacaatgctaaggaaaaagattcattatagctggcttgaggggagcttcctagaggtgatggctttggaagaagtgaagaattgtaacagcagaaaggagaaaattagggatcacgtgaagaaacaatgtaagcttatgtggatgcatttgggggatggcaagttctctggtttggttagaatgcatgagacttgcatgaga

SEQ ID NO: 45 - DNA, 732 bp, Homo sapiens
tgagcaatggacatggtcagagccaggcttggcagggctggcttcggcctctgggtacaggatgagaggggaaactaggggctagggcaggagtggggagactcagagtgaacagcacagggccagggaggaaccagggtagaaccaactgaaatagaagactctagaaagggatggttctagagccccatcaggccgtgtcactacgtgctacctggtagacctggtgtgtacagatttcttttccagaggcaatctttcagcctctgatcctcttcctggctcctaggcacctttctgttatgacttactatgaacattcaataggctgtgactgggttttactgaggtaaaaggtaacatcggcagaggccagcccgcctcggcctcattagctgggggaactcgaagtacagtcagacagggtggggcaaattgactcatgcctcctcattctgtgttttttcatgggaaaattccgatgtctgcttgaccgcccgtggtgattcattttattccatatgatgaacatctgattttctaggaccttcatcttcatttcactgaacaacagccgttggaggatctcgtcctggagggcaaagcaggcatgcgttctattgacttcttttgtgttcacggccttgctgttcttggagtcgttttcagaagtctttggtttctcttcctccttttaagctccccagcaccaggaaaaggggaaagttggtt

SEQ ID NO: 46 - DNA, 313 bp, Homo sapiens
ctcaaattcccgagtcctccacttgcctttggttcataggaatgcatgagatggcccgctaatctgccagtcacagtggacataaagcccttagcctaaatatatctatctccagagcccgtttttccaacatgcctctctgagcattttgtcaggctcagtacgatctcaaactgcgaagtctcaatggtctcatgacatgcttttatctctatgatcctcatctctccctcccctggttaataacacttattttttttttctttttggattcagctacaaactaatggtctttaaaaatgtttaaaaatta

SEQ ID NO: 47 - DNA, 87 bp, Homo sapiens
tttttttatttttttcacattaaagtagttgttactcttgccaaagcatgttgacatcaaacatgaaataggagagtctggggtggt

SEQ ID NO: 48 - DNA, 416 bp, Homo sapiens
tcttgccccattatttcgacacctaccctgttccctacccacctaatctagctgcaaatatcccctatccctgagctgaagccaagccccatcttgtgctcacctgctggggctctgggagggtgagcttgtgttcatacttgaccaaccagttgctaagcaacagcagaaggaataggaacccaaacaaggctggcttatagctcatcagccaagctgccactgctcctatggtgcctgcggaggcaagtatcccatggagactcctaaagagaaatatcagttctgccagcattatggcgtggaggcacacaggccccaggaccctgcctcaggcccctccatgacaagagtcacggccacccactcctctgagtcatagccagctccctccccccacccagctgccgcataac

SEQ ID NO: 49 - DNA, 224 bp, Homo sapiens
attcaccagtacttctgggcctcgctactagcaaaaaaaatggccaatacagagcccctaccatcataggggcaaagaaaagttatccaaacttagacataactgctttcacagttatactagcccatctattggtcacctgatactttaggggaaggtaactttgtttaatataatatgtaatattgattaggttttggactctgtatagttagacattaatt

SEQ ID NO: 50 - DNA, 73 bp, Homo sapiens
aggaattctttatgtaaaaatatcagttttagtggctgtgatattccaatatagaatcatgccttgctaggac

SEQ ID NO: 51 - DNA, 113 bp, Homo sapiens
atgagccaccgcgcctggccaacattatgtattatatttttatggtgaaaaataatttagctcccaagcagcacctcccccaacaacctccctacttccctaaatccttaaaa

SEQ ID NO: 52 - DNA, 75 bp, Homo sapiens
atacattttctttcttgcatagcttttactttttttcctttctacatttgattgcctttttgtctgtttgcttag

SEQ ID NO: 53 - DNA, 289 bp, Homo sapiens
tttttgacaatttcacttcgaagagacagactattaaaaagacaattgtttgtgtaataagtacacgcatgctaaaagtacacgacctgttccagttttgggttagcaagggattcctcgaaaaattaaaagaataaaccgctactatcattattagaaagaattaacctggagtagaaagaggtgttatgtggatggggatgggggacatgaaggatgggggacatgggggatgggggacatgggggatgggagaagcgcaagacatggagtgcgaatgaggttgggg

SEQ ID NO: 54 - DNA, 143 bp, Homo sapiens
aattccgtctggactcaaacctggatttcgtaacttgtctccattttactaccatcgaaactgctgtgctctccaagttttttgcccagtccaagcagggcaattatgaataagtaagacgctctaccaacatatttcagtgt

SEQ ID NO: 55 - DNA, 421 bp, Homo sapiens
aattgggtgagtgaatgaacgaacgcacgcatgcaaacccgaaagtccctggaggaaatggtcaccttcggaggtttagtctggcccagaagccctaagaccacggactgtgccaggtcccactccaaacgccggggagacgctctaggcaagctacacgttctttgctgcggtgccactctagccgcgagaacgccgctctatggctgcgggggaggggcggggctcgtgggtgtctccgaccctttttgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaa

SEQ ID NO: 56 - DNA, 1001 bp, Homo sapiens
aaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtaaggctcgacccttccctcaaacgacaccgcctggtgccgagcttccccgaggcttctccgccctcccccgccgccgccgggtcttgggccctgcgaccactcagacctccccttgtatcgctgcgcacgccacgtcccctctagctggacgggtggggtgagaaaggaaaagtctttgccggtgttgactgcggtctttgtgctgggtcccgagcgacgtgggaaggggcatcgatgattgctgggaggggtattttattccttaggtctttcttgcacaccttttcattttcttgactggaaaatggctccctgacgtggggttacggttggcgttcttggagacctcacttgtttgttcacagataggtctggaagctgttgggcgatattgatggcgtttcagctgggtgcacgagggggctgtaggttgatgctgaagaaatcgccttagccggggagatgaaaagaaagggtcgtttttgcttttgtttttgtttgagcaaaaccctgctgtgtggtaggagttctagtctttttttttttcttttttaaaatcctctcagcgatcttttggcgcagaattttgcagatgaggaagctgctgattgagagagcaaataatagtcaaaatgcaaatatatgggaagaaaagatttgactccaaacagtatatacagacagtgactgcctcaaatgt

SEQ ID NO: 57 - DNA, 558 bp, Homo sapiens
gtaattcccacattcatgttgttacagggtatcatcagcccttgaaacaaaggaccacatgggacactgtgtgcagggcactggggcagtattagggcgcagactttagacttgggccttttctggagatttaatggtcggtctagttggaaaaaacaacctggatatatatgtgcgtgtagtcaacatttaaataaaaatttgcagattatataatttatgcctgaaaaaattgtctacataatttttaagtgggaataccaagtcagtgtgtatggggagcttcttgagatgagtattacccagtctgagagctctcatatttatctgcctacttgagccaactctctaaagtataaccagtgctggatgaaagaccgttttggaggcaagactttctggagcttttaccaaagcatgggttagaaaagcacagaggttggtgacaccagccctcagaaatgaaataaagggcagaagtcaagagtgttattttacgatttcaatagacaggtggccagaagccacgtataagatgtttttaaaaacagatttatt

SEQ ID NO: 58 - DNA, 76 bp, Homo sapiens
cacactattagattttactgttattttttaagctatctcctacaagaaagatttctttttttagctaactgattaa

SEQ ID NO: 59 - DNA, 303 bp, Homo sapiens
aagatttttttctttgtaattctcctgtgtttattttaactcatcttacttaccctgttttttaatcccccattgtaattagctcttaaactttcaggaaaaaaattagttatgtgtttgtttggggcagcaactactaggaagctagcaactatccagtcttgggatccagaggaaacagactttagaggatagagtatccatttaaggaataaaaagcaagctgaggccagtatagataggccatgcttcagtagttcttcagtgtatgcaaggaaaaaagtgcatgtattttatgacttg

SEQ ID NO: 60 - DNA, 490 bp, Homo sapiens
ggcatgtgtatgctaaaattatggcaaaatatttaaggttttaaattggtaaattgggttggaacttcacgaacaccatactcctttaggaatggtggccttgagctaggccatgaaatggcagaatttagaaaagtgttctggaaaagggtggactttttggagtttaagtatttcatcttcctctgattcattttcctcaggtaaataagccctaccttgtaaagtttagatataatataaacaaaatgcttattgcagtgtttggcgtataattagtaggtgaccagtaattaagatactaccagtggagaaaaggaagtggtttgagaagcatcagggaatccagagtggacaactgaatgttgagaacaatggacaaatgaatttaattagaaacaggaatcatctaggaacaagatagattgaagggaccagtagcgttggggttgtagagttgtgtccaggttgtagtgagcattagattctt

SEQ ID NO: 61 - DNA, 61 bp, Homo sapiens
cttgaactagattatgaagtgcagaccataagtgctgtgagacttcagagaagatgaaaga

SEQ ID NO: 62 - DNA, 181 bp, Homo sapiens
aggtgtattttttaaatttagaataattaagaaataatcttcagaggaggtggaccttgaatatatggcattggattaacagaaaaagatggaagtagctttagggaacttagaggttggtagagcagcattgaggacttttttactcgtgtgttagtgattagaattaagtttgaattca

SEQ ID NO: 63 - DNA, 150 bp, Homo sapiens
ggcagtttgaatagtcaaggccagagagtgtatatgctggtttgaaaaatttgacgttcatatctgttaagctattagaaaatatcacataatgggaaaattaatctggcagctttgccgtagataaaagggagaaagtttttttttaat

SEQ ID NO: 64 - DNA, 367 bp, Homo sapiens
caagaaatatttctttataaagactgatgctttaaggacattgaggagtgaatgaatcattgtaataagggtggggaggagaaggaagagactaaagatttaaatttcagagtcatcaatgtgaaagtaagaataattaccctactcactcatagtctgcctgttgggacatctttatgtccttggttgtaagtagttgtagaatctctgaagtctttggggtttttacttagggatgagagagtcccaatcctttaggttcaaagtacacattccttttctcaggggaatagtttttattgaagtttgtatgattctttcagatggttttaaaactttattaaatggtcacttcttggctctgggc

SEQ ID NO: 65 - DNA, 294 bp, Homo sapiens
gcaaaaatcccaaaataaaacacactactattaagtagtattaagaagttaaaatttataacatttattttagttgtcagtctatgagaaaatgaggtgaagccaaatttgagattggaaattaagcatgatagtcttcttttagccttagaatccatttttttcccccagcgactagaccaccagggaagaatccaattttgtttctgtattttgctttgtttatgaagtattgtggcagtctggtactgatttgacaaattgtgcaaaaggtagaaggttggttttgtttgc

SEQ ID NO: 66 - DNA, 430 bp, Homo sapiens
ttttttttttttttttaagcttgctttgtcatctcaggatgctctcagttgaacagacatggcagaagaaacttcattctgaagtctaccccaaattgagttacccaagcagcacaagttaattgtgttggttgtctctaaaggattaagatttgttttaacacatgaatgtgtaatacatttaaaaaattaaaattctaaatcttgaagaatcctagggttctgtgaaacagttttgtttttaataataccatcagatattattgcttctacctgtaggtatttttctcatctcttttgttcctaaagactaagaaccctttctagaccacccttttccaagtgtattccttgttaattatttctttgtcaaggcattggattaaacaatgttgaaaagattgtttttgatgcaaaacttagcagtacc

SEQ ID NO: 67 - DNA, 629 bp, Homo sapiens
aactacaatagaaaagattttgtattagtctttgtttttgtctcaaaatttgcacattgtccagttccatattaggtacttaagtcattattgaatgaataggattgatggggcagaggatcaaaggactgaatctttggggaagagtcaagcactattgaggggtaaaaggagaaagaaaactgcatactataaaagtttatggtctattctgacttctctccccctttgaaacttttttttttctccttgctgcattttcatccattatcctgagacctatttccacagtttatctcagtcagttaggataaagtttagtataatatcatctacatttctggagtcttattgcaaagaccctgtatgagatggtcacctgatcaggatcatttaattgcaactagattttcagctttttaggggcagggacacagtcataattgttttctccattgtaccacgtactcagtgttcagtatttgagtaggtgaatacaattattcatgtattaaataagattcttagagcatgggtcagaactagtcagttcattcttcttaatttgtgtttccattttctaacccaatccctgttttcagtaacactcttgtacttccagcaaccag

SEQ ID NO: 68 - DNA, 73 bp, Homo sapiens
catgtgattgaactcagtctctagaaggtcaggctgatatcatgtggttcaaagccctgaccctctaatcaca

SEQ ID NO: 69 - DNA, 1945 bp, Homo sapiens
gtcaaactctttattacacagtaagacttaaaagtagtagcagaatattttgtttgttttaaaatcttagaaactgttccaattggaagtagtcttctggaattagcatattcttatattactaattcttcacataatgatcgtaccaaggaaacacagttgattttggttgattgctgagactggtttgtactagacttacagtatgcctttaaaaacaaaaacaaacaagtgaaaaaaaggtcctgcccaacattgcaagaattatacacaatttatattattcactgggactaaaaaattattgctagatctttattttaaagtggtctcctattcagcaatagaaaattgaagataattaatgctttctttatgagaggctgtggagtatgggattgctgtggcatcaaattcaacacactgagagctgagatttgatgcatttctagagatagtgttaaatgagatcactggatcctgctaaacatgttctagtgctcttgccttttgctgtatgtttggtgtcattcatcagcagggaatggctgaaatgtgaggtgtaaattgacagagtagagagaacctatacagttttaacaccatagccacagacatccaggcatcctaacattttgtcctaaatcttcctgaacctggacggcaggatgagaacactagtgattttattggaatgaagccaagacaaataacctttttttgtgctctttataatatagctctcaagaatgaacaaataaaaagaatggggtcaccatatatatcattgtttagcaagtgacaagtgacacagtgagcaatccttagtcagtggcatgacaaggaaatactcaagacagacactgacctgtattgtgaatgaggtgccttggtgaagcaaaggtttgggcccaatagtgagtcaaggagccatttcaaagatgggctacagtcactcattaaaagggatagaacacaactgtgctgatcgtagaattaactgtgacttgtccataaaatagagggaggatgcaatctgttttatagaaggcatatcttgcagggccttgtagctttgttaaggatagatgatagtcagcaggctgaaattttctctctagtggaccactttgacacattctcaaggttttatttgtatacattaccacaagacatggacttcagttacaatggcagcaaatataatacatgctactaactatgaatttttaggtaagatgaaatgcttcttaaaagactgttggtcagaaatctggagattggtactttttctcagaaagaaaatcagctcaacctaatggctgtatactgcattgtaacatttatttttatttaaaagttggatttttatgatttaaaaaagtaatgtgagtcttcatttaaaagtttaaatggcataaagacagcaagttttcatatagtagtaaaattgtatgaattttagacaatgattgatggcctctcttgactgtatcttaaacaaaaggacttactgcaattttttcattatcagtgttatgcaaatataccagtaaacgactgctttctgagatcttagggaagtaatgattaatgaagtataaaaatgtaattgtaattatatcacctaaattatgccaaagagatacattggtgacatacttatgctaaaaagagagagagaaaaaaagactccctctctccccaaatcttacaacacattaaatctgtcttctgttgcatgttgaatataacagtatcaggaactagatgaaagttggttattcatttatgatgatgatgaggctgctgaagcagttggtatagttttgtgcattacagagaatgttgtatgccagttaacaaatagacagccactatgtgcccagcacagagagaaatgagtcatggtttgtgacctccatggatcctaacatttcttctc

SEQ ID NO: 70 - DNA, 353 bp, Homo sapiens
tcatggcataagcttccgaaacagttgaaggatgagtaatacacagaaaattgtcaggagaaaattatgtggggtataaccattgcactagattgttttgtagaggagacagattggcactgaactttgtggctaatattttagaccatgagataggaaatgtattcaaaaggctgaaaattacatgggagagagtaaatatgatcagagatttgacccataggctgttacctggagaatgcttgggtatacattgacttataactaagaaagatgaatttcaattttctgcttaggtatgctgaagaaaaattaaaagtgtaactccagagaagtaagttcagaaagttagc

SEQ ID NO: 71 - DNA, 1415 bp, Homo sapiens
gcacaacactcaaattgtcttatccttttgaccaaacaacaagattgactcaagtgccaccactaaactgaactaattttagtgaaattgactggatcatcaggaagggctgattttttgtcccgaccagaagtatatatggattttatctttaactagactcatattatgctttagggttaaatagacatttattattaattctggctcaactcttttctgtgtgttccacgtgccttaatttgttggtcttctagtatctttgcatttggtctgtaggtttagattggctttttcaaagacaaattttctctaaaatgtatggatatcttttatttttgaaaggacactcttctcatttaaaactcccatcaaataaaatagatagatgccgaggcacagggaaccaacacatacattccagtaaagagataggtcccaaaacagtgaaccaacaaatgcattttaatacatagttagatgtccaggcacagtaagcaacacatacaaatttcaataaataagtagatgccgaggcacagaagaccaacacatacatttcaacaagtagatggatgctgagaccgtgaactaatacacacagtttcaataagcagatagaggctgaggcacagcgaaccaatgcacacatttcagtaatggatagatgcccaggcacaaaagacctacacacatttcaataagtagatagatgagaaaaaaattctcattaaataattaattattgtaccacaactttgagaatgctttgaaaaatctttccaaactactgtagcaataaactaaatgggccagttggaaatttcttgctggaaaaaacataatgtgttataggagagatggtttactgaaacgcctaactggtatggtctgtttttgctattaaaacgacgttgccagtggtcaaataaagtagccttttattcctgaatcattgtacctccaatattacaactaattactggactagttttttctttaattcatagatgggatgctaataattacttcagtcatgatattttagataaacattttttattaggatgaaaatgtcttatgcatctattattaccaatatttggagcataactaatattttcttagtgtaactatgtgtttgatgtaggtaatcatatctggaatgagccagaggtttgaagtaaaatgcctcaaattccttttgtgccaaagtaaggcatatatacaaatataagattttatagatgtgttttcttcttctaagacttttaatttgcctactgattttttaatttccaccactgccaaggaatagaaataataaaataaggataactcttgggtgaatacaaaagtttggattaaaaaagtaaaaacaaagtccaaaaggacatctgaatattagtctaaag

SEQ ID NO: 72 - DNA, 541 bp, Homo sapiens
ggtctctggtgccaaaaaggttggggactgctggtctaaagaataagagaaaaagaactactgaaatgaaaatcatgccattcatcatgggacagataagaagaaggaagataaaaggtactgagcattgttttattccatctatcactattagtgaatctattagtgatacttttttacaattaccttttcattctgggacagatagctgtcctctgcacattcattgttttgacagccatccttctgaaggacaccttggttatgtggagtttaactcatttgattttcctattggttatatctgttgttatgggcacagaagatttggagcaaaacatttattagtaccagttcctacttttttaaaaagatgctagtaaaaatgtaattttagaaatattggatgagagtgtgctagaatcagcttgaaagacaactagacataggcagatggaactagaatcatagagaattaaaaatgagctctcctggtgccatggaggctaacacacaaatccttagtcatcatctccaacta

SEQ ID NO: 73 - DNA, 649 bp, Homo sapiens
ataacatgactttttccttccctttcctccttccttgaagacacattggggtaaagaaattccatgatccctcctgtgcctaagccaccccagtggacctggtcttcttgcaccatccctgtggctggaggtttgagatactgacaggtatatttgatggccagaagtaggtgggtcaaagcttctttaaagttgaatcgaactaattgattagtcagtgagtttgatttaacaagagtgaactaacaacctattgtgcagaggatgcagggatggcagagcttctttaaacaagagcaagtcctctaagacagagacgtctctgttgtagcaccttgaatcccaccacctccatcccagttcccaaacccttctgggatctggcccaggtaggagtctctacatccctacttccttctcttcacctgccccagtgatcttcaattgtggcccttccttaagaacagcgaaggcttatggggagatgtaaggtctatcaccataacaattaaaaaagttaaaactcactttaactttactaggatttcttatcttgagtaaatagaaacttttgggcagaccagaagttaaaggtcatagagagtctgaggaattccttgaaacaaaagttcatataagttttctttcc

SEQ ID NO: 74 - DNA, 699 bp, Homo sapiens
ttaaatccaacttgactctttggacctgtggttgcctggcctgctttctgttaaccctcctaactcctgtgcttgtaattgcctgtttcttcttgtcttccccaactcaagtgtaggagtctcttcctaatgatgttctacaaagtagaggagtaggatttgagaaagttaaagacatagttcctaccctcaagacacaagggactattatacatatactgacattatctcatttcaatatgttctacatattatactgatattatgtttatcaatattaaaggagtggtgtcacacataatggctgtatagaatgagacattactcagctacagagagatcaagaaaggttttctgcagaagatgggacaagggtaggaggatttagatatgtaatttttagtgagggaagggcagggaacatggcatgtttttggcatttgtgaaatattttgtaactagagaaaacaaaatgcaataagaaaaacaaataactagagactggaaaaccacttaggagtctataatatgatgtttgcttttaaagcgataagacactcaacgagaaatgacagaaaaacaaggtgtggatggagaggcaacatgaaagtggatcaaacaacttatacatgggtgctggctcagacgtgacacctgaggctccagaactggaagtttatgccgtcaagtaaattcatt

SEQ ID NO: 75 - DNA, 29 bp, Homo sapiens
gtgtgtatatatacatacacacatatacc

SEQ ID NO: 76 - DNA, 219 bp, Homo sapiens
gtaaattcattaatatcgagtcacagatatgtcactgtaactccgtgtatatatgtatatttatatatccatattttctaagtatttgaataatttgaaaaataagcagggaaaagtgaaggctgtcttactctacatattaactgagtaaaaatattaagtaagaggttatttcttgtaatgtactatgaactcggatcaatccacaaggaaatatat

SEQ ID NO: 77 - DNA, 146 bp, Homo sapiens
ttttcttaaagaaagattgagaaaactagagtataagaggtagtggtttgcaaaccattttgtatgaaaagcagttgaagaactataagactagtattattttaagatatgtgaaaggctgacatttagtaaatggattgattatc

SEQ ID NO: 78 - DNA, 1097 bp, Homo sapiens
ttctcatgagaggtgatgtagacagtcctctgtgtgcataataaatggagcccattgtttccttctgttctcagaatcccttcagttacatttctgttttactcacattaacttgggtcttggcggtagtgccatctagcacgatgcctacatacagcagacactcaaaactacttgctgctggattgatttatgtttatgaatatgcagaggaatggaagcataattatcaaatttaccattgctttgaatagtaaacagccacagagccctgactctggccaacagatgtacagacatgggggagagatgatgcgataacatccagaataaaaccttagcaaacatgggctctattatctatgagtaaagtagcctggcagattcattaactttgatgatgttaacagttgatagaattgttttacgtggcccaaatgaatggagattcattgtattaccagcctattttattctttgcaagctggcaatgaacatatactatccttcctccatgcttctttgacctcattctttcccttatcttagtgtccagtgttttacagttatcaggtgaattaattttttcatagaatattcaaatactttgtcctgtctacttctcagaattctaatcatcaacaaggatatacaactgtaatgtgccaatgttcacaggaagagattttagaaaataacccatattcctttagctccatgtactgggtagctcttggaaactgtatgaaagactgtgtgtatgatgagactctacctaagtgtctggaatacaagtgcgggtgggctagacagagaataatgttctcaacgcttgtcaggagactgttgccagagaccagagaaaatggcttccgactgcttttgtcgaaccagcttgcagacatccttgttctgaccccagctcccacatgtctcttgccagccttatcagggcttcagttttccaggagattctgtggtaacttcagtgctgccctactcacatccatagagatgtacacaaataatccacattagttttgattctttagtaaaatagtatatctccacaaatttcttaggggaaaaaacataat

SEQ ID NO: 79 - DNA, 1250 bp, Homo sapiens
aaagtccgcatatatctcaattatgtgaaagtgttataatttatcttctgttggatacttaggtggtcctgaattatcaatattatgaatgtatttgttattactaatatactaatgataaaggatatttcttttacagaaatactctccccacatttattggtggctgaatgattagtgcttctcccaagtcaggctgtggaataacctctttccaaggctggggttaggggttaaaggtggagagagagtaatgatgagtgcttgggcagtgccctagtgttctggggagaagcctgggcactgggctccctcagaagaggactctatgccttcccacatctggtgaccacactgctgtttgtagaggagagaggagaatcagaggagtgtgcaccatgtaactcaaaacaaaaggagttacacaaacaaaagctcaggagggcatggtgcatctgggaaagatgaggtcttcacagtggttgtatcatacggaatttgcaggggagatgagagagatgagattatagaaatagacttcagatgcatcatcaaggagctagctgaggagtttgtactttattgtgtagacaatgaaggttttgataaagaacatttattcttcaaccattggtatcatcaggtcaaattaagatatacatttctttctagtaatgggtcttgattttctttgtatttgtgttttggtctttgttacgtcatcttttaatggtggcacaatggtccaagcttcacttttcagttttaccttttgtttacctatttcttatttgtttgtatatccaagatgttttcaaagccaccttatttgttccacaactgtttgtttggaagtcaaagctgggatcagtgatttgcttagttctaacatgtagctgggacaatttatagaactgattccatgaaatgatctcttcaaaatcatgggtggtcaggaaatggacacatgaaatcacaaaatacattgttacagttaagtcacaactgtggtgtagagagaaactcctttcctcaaagtccttagaaaattccattgcatactttttggaatgttttagccaagttaaggctaaggctaagagatgtagaaagggaaatagaaaattgaagacagtggtatccttgtagttaagaagcagaaaatctcagagtaaaatttgtcatataccatttgcaaattaatatcagatgctctaaattcattttgtaaaactatttgttagcttatc

SEQ ID NO: 80 - DNA, 1464 bp, Homo sapiens
cttcattgaaataaaacaaatgtgtgttggctttgcatttactattctcagaagtatgagaaggtcagttactggtatcagtgtttgttctcccttaggtgattctgtttatgcatatttgacttactatagaagttatcatttttgtaggtctaatgtcaatttgaattaaaatgattcatttgtctccatcagtgtttctgctatcattgatttctttctgtcagtattttaaacaatagcatcactctgtggaaagtgaaatgaatgtcatctagcatagctaattttttaaaaattataggattgaaaaggctgcatcaactaatttccgtgttttcttcgtttctaggttacaatggccaacattggaataaatggaaatcattctctggaaacctgtgaaacaacactttttgctctccgaatggcaacatggaatcaaatcttagatccttgggtatatattcttctacgaaaggctgtccttaagaatctctataagcttgccagtcaatgctgtggagtgcatgtcatcagcttacatatttgggagcttagttccattaaaaattccttaaaggttgctgctatttctgagtcaccagttgcagagaaatcagcaagcacctagcttaataggacagtaaatctgtgtggggctagaacaaaattaagacatgtttggcaatatttcagttagttaaatacctgtagcctaactggaaaattcaggcttcatcatgtagtttgaagatactattgtcagattcaggttttgaaatttgtcaaataaacaggataactgtacatttttcacttgtttttgccaatgggaggtagacacaataaaataatgccatgggagtcacactgaaagcaattttgagcttatctgtcttatttatgctttgagtgaatcatctgttgaggtctaatgcctttacttggcctatttgccagagaacatcttaatgcagcctgcatagtgaaatggttattttgagatcaccgctctgtagctaacccttataaactaggctcagtaaaataaagcactcttattttttgatctggcctattttgcccctcattgtgtagcctcaattaacacatgcatggtcatgacacccagaattcatgatggtttgttataacaacctctgcatattccaggtctggcagacaggttgcctgaccctgcaatcctatctagaatgggcccattcttgtcatatttgacaaataggactgcctacatttattattatgaaggtcgattgttgttggaagtgttttttcatgtcatagattagcaattttcaaataattattttttctctgaaaattttgtgtgtgattgcacaataaataatttttagagaaacaaaggctctttctcagcacattgatgggcaactagaattacagcagtttcaaaactctaccatggataatgcaaac

SEQ ID NO: 81 - DNA, 845 bp, Homo sapiens
ttggggtcctgtttcaagtagaaagtcaagagtggctgaggtcataaacagtgtcttgttgctgatacctagcacagaggatcctggtcattaaaacatgacacattctgtacaaaaactacatcaccgcccgtgttttctgtcatcctatttcctctgaagtccaagtgaagaggatggtgtgcctttgcttccatctggattccaagactccctgccctgtcttgccctcgaaaatctgaaggtctaagaataacctccattccgtattgaaggccacagaaatgaatacattcctctcaactacaagcgggagtgtcttcttggccaactcaccttatgtattttgagctccatctcctccaacaggtgatcatgctgaaatgtgttaatacggcccttaagagccattcctctacctgctactgtgacccctttactgggggtagtcctcatgctgatcatctacagtagctgatgatcccaatctccagtaagccctgatggcatcccagcatcccagttcccttacggttatcagctcagcaaaaccaggcaacttcataaatgggtagcagcgtgggcctggctgagcctaaataagacagggaagatggagttggtgactcacaagggatagatctgcctaagttgatatctataaaggcttttgttttttctgctgaaggagaagggacgaacttggttcatgggtacctggggggagagaagggagagttgaaaacaatggagggaatgatatggctctccttctgtctctgctgtgctttcataaggtaatggggcaggtggaagggtgacaggcatcatctaaaaaagaacaa

SEQ ID NO: 82 - DNA, 654 bp, Homo sapiens
gagcacttggcaaaccctaatagcaaagtgccatggcacgattattaagatcacctcttttcagtctctttgttagttccaaccaatatctatgcttcttggactgttcagtctaaaaatcaagggccagagatgtcaggtatcaccacacacatggtcttagttgaagaacaagaatataactcatgatcctcaattaaaatccaaggaagctcttaaaaatccaatggtttacatcacctatgtggtttctattgctacagttaactcaggagctgtggagtttcaaaagtaggtaaataaagtctgtatttctgtttttccatgcttcagtatactcctatcagagagaacaatagccagtggttagtggtagatctgctgattaaatatgtcctgattaaagaagatattctgtgcagagtgtcccaggataatgcggtgaaactggaaatgatccttgtttaactttccgaagtacttactggaagctacatctgaagaaggagcaagagaaagataccaacaatgccttaaagccttcagctggctgggtttatcagattctaaatgtatgaagtcatgatctcacaaaatcagcattgctacatgcagtgagtggaagcctcaaacccagcagaactacagaaacaa

SEQ ID NO: 83 - DNA, 266 bp, Homo sapiens
gaatgagtttagcaagattgattcatgtcaaggaataagcattgcacaatttagtatctttcttttctagacagttcagccccatcagtctttaccatttccctttctggtcccctccaactcacacatagtgtggcagggggtgaaaggaagggtgttaaccttggctaagaacctcctctctgtagacatgactttggttgctgcagttttcagtctttatcttacttagttctcaacactctataaagcagttattttaatgt

SEQ ID NO: 84 - DNA, 570 bp, Homo sapiens
tttttggatcacttcccatctatgcaatggttcctccttcctttgaccctttccccatttgtgttctatacgtggcctttccaggagacaaggttgccaccttctattcacagcgtgctttaaggacctcagatagagccccctgcctgaaaaataccatctccattggtcagaaacagagattgaataatcatttttagagttggctcctatgtatctaaaaacctttgtattccttaaacatttcctattgaaatgcaaataaatatcccttaaagaagtgactccttaagcctttgtaaggtactatgataatctacttcccatggtaagcctttctagaaaacaaaatcctatagaaatgaaacatgggtttgcaatcaggagtggggttaaaatgagtagcagaaacccttgcaggagaatgaaaagaaggtgaaaaagaaccaaagacaaactttatctacattgttttcttcctattcatctggccttgactgctggcatccatgtaagccagtcaaactttggctcctccaaaggtgttaaccataaaaggattcctggatg

SEQ ID NO: 85 - DNA, 353 bp, Homo sapiens
ttgccataattgactttttcccaatgacttcaacaacttataaatatttcccatgtttcacaaagtcttactgggttctgaaaactacttctaatgtgccgtcctatccatctccagccctgggataagatttattgaccttaagcgaatgtcagtcctactaggccactttgaaatgatctgctttctcactggaatctaaaaacggagacagcagttgtatttttaaaatgtgtcttggcatcagtttcacacagaataaaatgtctcatgttccccaagacaattaactattgccacagttttggcagaacacacaccatctactctggtgctctcatcattctattaaa

SEQ ID NO: 86 - DNA, 2464 bp, Homo sapiens
tattctctgaatgttaaaagaatttttccctggcacacattagacatgctggatgaaatcagagagcttattttatcttctctgttggcggtgccccagctttctgaacattggtaagaacctgaggctttcaaaatcatgggcccatcaactaaaaatatgatgcctaacacactctaaaaaagattcccatttagaccaacaagaagtaattcaaaaactgtccttttctaggttacaccccatgaaatcacttaatcagctttgttttgttttgtttttctgccttggttatggagtaatgcaaaagaaagatttttcacatttcactttgctagaacataatcttttccagcttttagtgtcctcctacacacttagcagattgtggcttatctctcagagaatcatacatcctaccctttagctatctaagggaaagaaactcactgcgaattaatagaaaataagcccaattccttacctacgcatcaggtgtcacaaagcacaaagctttattgagccaagaaaaagatcttgtcataagaggataattgcttccacatttaacacctccaaaaaggacacaaatagctgaaaggcagatattttaaaaccatattaaatcattctagtagaaaatctcaaacttgtaaagtgccagaaaaagtaaagatcaattaaatatttgccttggagagtccatttagctcatgcaggaagagcgaaagctccctctgcgcaactgtggatggaaagagatgacatcatccagatggtaggaaattaactgggcttttgtacaaccaggtgatgaccaagaacattttaaaagaccacgaatctgccaagaacttttcttacagaggaaccgaagagcactttagtcttgatatcaaaacgacataaacagacttcttggcagtagccatctctgtcctggatctcccacttctcccatttcacttcttccatctgcccatcttgtcacctcttaaatctgttctcctccaggtcggatttcatcagttgccttccttacaaccatccccctaccctcactacccttcatgtcaatagaaatataggaagtatttttcactatcagaagacacaatctagtatttgaggcctcttctccatcttccattcctctatttagctatgctttagctgaatttcataattagtgtcaaatgggagaaatttgatgctgaagaaattgtgagttataattcaaatagtgcagaggtttgggggtcagtttagttcaaattagtgactcaatcataccaatgacttacagctccgttaagcttgtagtttctcactgatacttgatagaaagagttctgaagattcaatgccatatgatacctaaaccaacagcctgcttcatacacatagggcctagttctcctctcagggcttgagaagtcacaaacataaaaccagccctcattcctttgggcaaacaaatttctttctctcttccagattctcctgtggaatcagtaggctttgaaacaactaaaatacagcctagtgatgtagctgtaaaagatccactaggaagaaacagtgtaatgggagttttagagcaattcccaggggttaaagtggtgcttgaggttcagcagcatttctagaaatgtttgttcatttgctaagtaagaatgaatatagtccatcgggagaaactcagtcacacctcctcctgggaagagtccttttgggagtggcgtgactgaacgtgtgaataagcacatgtgtttgagggggcaaaagtcttaccattctagccggtcccccaccaaaggcactactcaggtgtttgtaacaatagccttccccatgtgaatttgtgagtggtgtgtgtataatataattactattttctttagttaagcctttacaagggcatttcttatgacaatgattgtaacattctctcacattacgattcctacagtttcagctcttggataataagcaaataaagaattaaactttgctaccaaaagagcatacatccctactctccaaagagggacagagtagaaatgtcatcttcatatacacaacactgaaagatacacacacccataaacatgtgcacacacatacctgtatacacttaaggcaacagatatctcttctgctaccccaatccctgccagccctgcatgaaatcagagggggagttgggggctggactctagatgagtcaagctggagcttctgggaacactgccacaatgatctcaataccctgaagctttgcagctttctgcagaaagaaaaagttttaacctgattatggtggctagtttttccactcagctgcagccaggtgattagaattcaagctgatagcaactcttggtcattcctggaaagaacaggatataaagagaagtccgttttcttttcatgatcagcacagccctatacttggccactt

SEQ ID NO: 87 - DNA, 37 bp, Homo sapiens
tcggaaccccaacttcttaactctcctatggcagagg

SEQ ID NO: 88 - DNA, 382 bp, Homo sapiens
cactgcacatgggcctattttttatgcatctttgttccccagtaattcagaaatccctaatttcttgaaatgtctttttcttctgcttccatgacactatcatccctcgtcttccttctatctctctaaacattcttctgtctcagtttttaaactgcccaacccttacagtggggaatttttcccaggccatctcctctttcaaactcttctcactttgtatgtttttctggaatggtccttcttccctgtggctttacctaacaccaatctgctgtagcttcacctaccaccaatctgctgatgggccccaaatctatctccatcacatagtcccacattcaccagcttcccacctgaaaacttccccttgtgtgtaatc

SEQ ID NO: 89 - DNA, 109 bp, Homo sapiens
tgtttctttaatctgtcaccataccttgttcagagtttctgaacaaaaacatgcacatagtaatctgaccattagaggctttctctggttctctgttgtcattctaaac

SEQ ID NO: 90 - DNA, 239 bp, Homo sapiens
accactgtgcaaaactgccttcatcttatactaaacttgtgtataacacatgaggcccttcagattccagcccaaaccaccaacttatttatcttcatctcccttcttacattctagaaatcagacccactgaatttgttactgtcccccaaatgctttgccctttccacagttaaataaattacttccccggcatagtcttcagcatgaagcaagtgctcaaaatattttacttcccc

SEQ ID NO: 91 - DNA, 162 bp, Homo sapiens
agtatatgaatgaatgacataagcacttttcataaatgctctcattgttaattagctctcttgaggcctaatcctagctgctgttgttattttacattattgaaaaatgtaaaaaatgtaaaaaagcatcccaaacgtcactgaaaagcagttttaagttat

SEQ ID NO: 92 - DNA, 104 bp, Homo sapiens
atttcgagtttctagttttatgagggtagttaatgaggcttgggtaggataacattgagtcaggaaacttttctttctcctccaaagccacatatctaagacaa

SEQ ID NO: 93 - DNA, 339 bp, Homo sapiens
ttagttccaatttaacttaacaaatagctcagaaagctaatatagcatatgactacacatctgggtgataaagatcatctttttaaccaaatacaacagctatttagtctcttttatataacattaactttataactgtttatcaaacgttgagaaggccctagttatgtatagactttaattcacatagtggaaaatatttaaaaatagctaatacactagaactttctaaggagggcattatccaaaagaactcagaatgagaagggatcttatattttattaaccttataataaatctgatattcattagatgccacttcaaattcctactaagga

SEQ ID NO: 94 - DNA, 1133 bp, Homo sapiens
atagaaaaattttagagtccaccctttcattttataacaatcagtaaagtttatttttttactgggataaagacattattaccagctttgtctccatggttcttagaggtcctctagcctaactcttagccaattattgaactctgctctgacaagctcaacaaatctgtggaatacaagctgtggaaattttaatatttgctaagttcagttatcagtactaataacacctatgatataattatgtttcataattaatttggaaatttcttaggaaatagaattatataattgccattgctatcttaaatgagatgcattttataggaattacaatattagtggttttattacacaaaataaaatttcaggaaaacttgactattatttagtaaatatttcctatgaaggttactataattgtaacatgatgtggcacaaaaaatattggtcagaaaatccagagatttgcgttcttttcaggctgggcctttttttattttgccttacctcaaaatctggtaataaaaatgatttgcctgactcaatccccagggttgttgcaaaatgaattatttcatttttatatttttaagacaaaaagtagataattctttaatataattcaaagtcacaatattcatttctatctcagatttaaaagccttaaaaagtctctacagttttcctccatgttagtaaacagcattgtttagaagaaatgaagaaaaaagaaaacaaagccaccctgaagttgctactatataatcaaagcatgaaaaatagtttcttaccacttctcagctgttcaacttcacagaagtgtgttccagtgggagtgtgaataaatgcatggacatgcttaactccattctgaaaattagggaaacaaattatttccaggaaaatttcagttcatgccataaagccaatttctttaattaaactgagagcacaaataagtgagttaacctttccaagatgcttccaagggatttcttccatgtagacttgagctcggattacatggttaaaagaagaaagaaaatgctcacaaatattcacaccaaaggcttctatgcttttgatttgtaaaaagaaacaaaatgcttcaaagcagaaataattgtccc

SEQ ID NO: 95 - DNA, 487 bp, Homo sapiens
ttactcatgatgttctctttcctgatgaattgctttttagaactagacaagcagagaatagagtctacctcaagagaaaaaggtgtttatctcacttttttattagagctcccaaatgaagttaataatcaccatcaccaggtgagactctcgtttttaaaagaaacccattttgcaggagaggatgtgtcagtggatgagcaaaaaataacttaacattcagattcttctcacagtgcgttcagtcatcacttgtatcaaccacagcacaccacaacactctaaactctatgaggcttcccattttcccaaggaaaaatgttaatgaagggccacctcactccttaccttgcatacagtccttctattgatcccagctctccacccccataatgcagcttccatattaatccctaggtaatattttatggtcttagcacagtctggaaattattaatggctttgcctataattaaagtgaagtatt

SEQ ID NO: 96 - DNA, 448 bp, Homo sapiens
tccataatgaatgactttaagtagtttttaacattcaggtccattcttcacttttctgcaaactcctacacagtacaggaaatacaagaatctgttgtacctggcccttgtccatatcacagcacaggtctactttcaaacgatttttttaaagaatgcagtacctttttccatagccccatctatgtttgctgggtcattctgattagcaagagaaaggttcagggtaaaaataggagttgcagaaattatattgcaatgtttgttcatttaatgaattatgggtatggatttcatgagaaaacatgagaaaagaagctttccagtctacatttcttgtctttttagacttcatggcaagtaaaaaaaaaaaaaaatcagcttgaattgcccagaaatctgggtgacccagcatagcttcactcacacttaaagaaaccataagtgg

SEQ ID NO: 97 - DNA, 1191 bp, Homo sapiens
ccagagctggaaatgctaaaatatcagttctatcagatctaagtctctcttgaaaagtcctaataaccactgtatatgaacagtaagtggtaatagagttgggaaagttagaatggcattaaaatttggaaaatagatttcaacaataaaaataaatgtatctcatactcaagatattcttctgtattaataacaagaagtgaaatgatattttcttctataaatgcacaccattctaaaaaaataaaaactaaatggtaagactcaaagaaatgcatgacaaaaatgtgtaaaattctattctgaaattctttcaggaccttgattttcctttgattctaattagagataacatgtattttgtccaataagattctctgcctaaaagattgcagtgagataagagccaaggaaacaaagatgtgaggtttgtgtgtttgtttgcttttctgcaaagttttcttcaatcctgagacctttaggctagaaaagaacatttttttaaaaaatggcttaaatgtaaaaatagattaaaatgcaaagggaactggaaataagcaagtaacacttcatgctgttttatggcaaattctgcatcaagataggcggcatctaagaagaatgacacatacttctttaaactttgccaagacatgaactgtgttcttgatggtgtctgtagggatgatgtctgaattatctccatgcaggtaatcttttttggaacttagagtaagttgcactgaagttgccacctctttaatgctgtgatattttccatctcactgaatatggagaacttttaccatttccttcccatagccagttcggacaaactccacctcatcattctgcaatgaaaacacaggcatcttattgaagaaggctcaatgaaagccaaaagttaggtgaaatttacttaaaccttcattatatcatacaattgtaaaagatgagattcagagtatatatggaagcaatatcacattctacttttgaagaagaatgagaacttgtataggaaaaagagaatcccatgcagcaaatgaaaatatatcagattgttctgaagactgacaggtacagggcttttttgataataataataaatacattaataggacctcctgggtcaaaactgtactgttttatttaatccccactaacctaatccttgtaatagcactgtaa

SEQ ID NO: 98 - DNA, 960 bp, Homo sapiens
ttgtagaatggccagtaggtgaactgcttttcttctataaaatatcttcactatgttacctggaaataattgcatgccctttttatagagagtgacattctggagaaaatgccctgtgatcaatagaaacaatttgaaaattgccttttctacttgctgccgggaagaacagtaattagtgacagggtccagattaccttcaggagtgcagagccaaggctgtctggctgcaggaagagctatgcttttagtgaagagacacttaataaaagcctagtgattgattcattactacccttgtctgaagctggagccttggctagtgaacacattcatctccactggtagaatccataagatttgtccctgggctttactggtgtttgaggaaagaggcaggagggagcagaagaacagaaaaaccttattttatttagcacagaaattgaacattaaaatgataatgaaagaaggtgacaaaaataaaagtaaatgaaaaacagcatgcagtgagagtctgggtaggagacaaagaaggaacctcatctgcaaatcacacttaggatgttcaggtgtactaagggctgcctaaatatctatttgaataaaaaatcaccagaccctctgaggggaatttaagaatactagccaaagtcagaaagtactgctgttcttaaagtagggggtgggaggctgcctccaatcttggagatagagctgggcagggcaggctattgttggtcattgaacatgccctcgggggttgagatatctgaattcagttctttcttgtgagaggttaaggaaaactcttggagaggcctctgaaaagcctctggcccaacatttggggactcatgctgaagaaaagggtcaataagaaaaccaaaggagcagactcaagggatctcagtaagaactacaagactgtcggggaaagagaaactgttgtgtggtagt

SEQ ID NO: 99 - DNA, 439 bp, Homo sapiens
ggcctggcttagttcccagcagctagtggtacactgaggttaatcccagcaatagaggccaggcctggctgtggaagcagcagcagcagaggtagcagaggggactgtgattaagggcgccagttttcagagtgaacagcactgggagcagtaacaggtggaagactctggtgtatattgagccacaagggactctacctgaaggaggaaggcatttggctgggttggggcccttgagtggtatgggctggagtctggaatgaaaggtctctgagatcatccatcatccccaacatgtaccaggactcgacaaatgttactccttagcttcatccctgcccctatatattcaagaaacagtagtttagcctatgaagacaagtggtacctacatggtacatagaaagattaaatgatagccacccttcttatccccatt

SEQ ID NO: 100 - DNA, 668 bp, Homo sapiens
ggtgccaccaccacctccactgcttgtgtgatgacacagcatagttaatgaaaacacacaaaggatttcaatacaggaagagccacttcagctcagaccccaattaggaagtccttttccggggaaagtggggcaaggaatttatgcccaatgatcaccacagcctggagatcacaggcacagctgaccaaagaacaaaaagccgaggaagggcagaattgagtatagagtcggtaaggcagcacaaagtgttcatatggctaataagacagccttccagtgcagcacagccatcccagactggagatcatgcaagacatgtgcgggacaggtcggcgctcctttgcaggaccctgactggactaagcagagttggcccttgagcaaagtttgagtaatcaagtttactggcaatgagtctgtatgaagggaaccaatcatctgatcctggagcaggtggaacaagcctggcatgggacacccaaaagcatccctgcacccaaagagcagataatggcctggaccataaccgaggctgttctcccccagttctctaatcagataaatcagaagtaggtgtcagagccccattgtgtagaatgtagggaatggtgcagagatctcatacggtaaaatacaaagggtgctctcttctggagagtgggcag

SEQ ID NO: 101 - DNA, 321 bp, Homo sapiens
cagcacttattagccataattatcattgataaataataatcactcgtcaaattttgcaataaaggataaagttactgacagagataaatacctagaatgcacaccaatcgagagctggagtggtcaaatcaaagggctgctgctatgataaggcctacttctgcctgcctaccctcaggtacattggccttctttaaatgttcatgattactgacactcacccctttggttgtccttcctcaggcttgtatggtttgagaagttataaaagtgaatcgatttcttagaataatactctggaaaaaatattagcaggaataa

SEQ ID NO: 102 - DNA, 253 bp, Homo sapiens
aggaataaatctttacctggctctacataagaaaaatcccctttctacacatgtcttaaaatgtaaagggattacttgtctgcaagtaatgttggggagagctctcagggattttaaatgactcatgtattttcacttctgcaataagatagtaagtgttctcttattttcaggccataatgaaagtgatatagatgtcactacaggtctaggggttcttaccttagagtcttttagcctccagaagtctcag

SEQ ID NO: 103 - DNA, 123 bp, Homo sapiens
ctctgtgtaattggtgtccaaattgttaggatcactttgatcaaactgactttgccacggtctgacaactagccacgaggcggcaggagggagaagacttggtcatttcagtgtacaactgca

SEQ ID NO: 104 - DNA, 123 bp, Homo sapiens
gtgtcagtaaatgttagctcttattattatctgacctgccaatttgaccaaaaaaaaaaaaaaaaaaggatacttcaaatcagttccatcagtaagtggtagggagacatccttgtttatctc

SEQ ID NO: 105 - DNA, 2266 bp, Homo sapiens
catctctttttgataaagaagactgaggatcccacacaggtgcacactgttttgtgctatagatgtacaactaataaaacaaatccttgtcaatactaattgtattttacatgaatcctagctgcttatacacattgagggcaaatcgttatataaagctaatattcttctccacccatgggccatactttttagctctgtgagtatttatgcatgcttccttttaataatagcactcacatatttgtacttacatgcaccaggtaccaaatgaatttctccattttctagttaaacactgaggcagaaagaagtacatttctctggccaaactaccaagatttgacttcaagtctctgtgattttaaccaccaatcaacactcttaccctcagcctagaatgccctctctccacagagcatggttcattccacattggaccttctccataaaactttcccaatgcccccaagaggaaatgacacctcttgcctttgaacttccagtgcactttaggtgaagagttactagctgctgaggtcactctttattattctcatgtgtgtacatgtcttagtattcccaatatcaatgtcttgaaggccagattgagtcatctttatatttgcccatagcacttgacagtgctttgaaaattgtcataaattatttgtccaagaaacaagcttcctcattttgcagattagttcagaaaatttaggtcatttttattttggcaggaaaaacatagttttcagctctaagtcactcatcaatggagcctcaggttcatattttcaagttacaggatgaggtggaggggtataaggagattcagcctatatcagtacatattttcctacaagaactcttatagggaaaagaaataaggttgatttttgtggcttgtgagctcaaaatcattctcagaaaataaaaatccttgtgaaactacccatgggcctctatattattaaatattagcagaggtagtaatattataacacagtttccaactacctaaacctttggcacatattcatttattttttacacagaactgcctcattttagaggcttcttttagctatagtcttatgtttttgattctagcatgtcattcttcaacatcaaatttctctactctgctggcaaaggcaggtattaaaggttattgttgtgtttaattttagcttttcccaatacttacatatgaattttcatttggtgtatgtgtatgttcaccaaatgtgtgtttatgtatgtagttttaattagagaaaaatgactggaaaatattaggaaagataaggggaaacttataaatataaattttaaaatgactagaattttctctcaagtcttagaagagcttctaaagcatcatctctcttctatataatagagagaaatacaaaaatactagctatgtaggacccatcacatatagataaatatcaattcagttgcagtgtgccatgatagaaggaaaaattattcatggtgacagcctcttttgtctttggaatgtggtagagaagttcttccaattattttcccaggtttctcctttgcctgctattttttgggcattcacgaacaaaaagacttcagagaaaaatgctgagctaacatgagaaaaatgagcactcatgtggacaatcttaatatcactttggtagattttaacaatacacaataatgataagaacaataatggtggctaatcttagtgacagctggtatctttttgattgcctaggatctactaaatgttgatgggaaaatactgatatccagtagggaaaggcatgttgctttaacctgcagagtggcctattattgctatcatgggggaagatatatgttatgttcaaagagtgactctaaagggatttgtcaagcagatgtttcaaaaacagtataacaactcatctgcataactatggcagaaacggtaacctgttacctaacaaagactccatttacaggagtcttcttttcattctttcacctactaccaagaaagagaaactcatcgctaattgccaggagaaatactaattttcttgccagcctttccacagcatcaacaggcttagggcactgaacctggaacaaggcccacaggagcttctaggattaggggcagaagatcccacaataaagaattgatggagaccaccaaaaacgcagctgaaagaacattttgctgaaattcatacattgaaagatgtctgtttcctaatgtatgtcttgaaaataa

SEQ ID NO: 106 - DNA, 110 bp, Homo sapiens
taggccctacacccactttgatggctggctcctgcgttcattagggaaagaaaggaagcatttattctgattccagcaaagcagggaattggccatgctgctgtagaaag

SEQ ID NO: 107 - DNA, 306 bp, Homo sapiens
ctgatacagtggaaaaagtcctgctgagatggaaaagacactgtgctaggcagaacttaccccacaccaagagctgcccctgcacaaaccatccctttttctagcacttcagtcatttttttttttttagttacagaggatcctgaactcagatgaattctgtgtttatggtgggaaggtttaagctgtgaaacaggaggaaaatcttagggtggttgcccctttggcttcatgccttcaacaacatggcactcatttgagtggaacacagacttttatctgataaagagcattgaaaacacaaat

SEQ ID NO: 108 - DNA, 133 bp, Homo sapiens
gttggtggagattccttcaaggacaaatcatgacacaaggattgagaacacgcttgggcagaaatcccagagagcaatgagagggaatggtaagtgagacaggagggacaggagacaaaccaataaagtggct

SEQ ID NO: 109 - DNA, 207 bp, Homo sapiens
actgagcacctctagcttagccctcaatttaccatcttctcaggaggcgagggcaccctctcaggcaaagggacacagctgtcatgccatctggcctgcatgagacctcctggagtaggcaaggagacagagagggcaccaaaggtattcactgcatgtacagccacttcttatagctgttgagctcacacagtgatggagaaaaat

SEQ ID NO: 110 - DNA, 1137 bp, Homo sapiens
gtggtggtgaatgctgctatattttttaaaatcaaggcaggcctaggtttagtgtcatagcgaaggagccaggcaccatagccagaagcccctgggtaggtctgggaagtcctaggaattgggaaaggtgaaaatagtacaggtatggggctgtaaaaggcaaacttcatgtcctgcagtgttctgcctgtggctggtcctgaggagcactggtgggtcagtttggccagacctccaaagagagccacaggaaaaaaagaaggctagaggtcctcatgacccacctcccaagatacaagcagacacttgaagtggaaaatccctgccactctgtaggacaagaactacgtggccaaaaagggaagctgcaataaatagttctggtttaacctgggatgcatcacagcttctccaaagttttgctttgactttaggcccaattcaaccaacatgaaacacccacaaattaactcccaggaaaaacatggctctttgagaaaagaactgacacttagtaagcagctgagcctgtcagtccaggttgcaggatggagcgagtgagctctcggcgggtacagtggcttgcactagctgaattcattactattccctttgtgcagccttgtgctttgaccactcgcatatatggaataggacttacaaaagaaaactgttttgtttggcaggtgggaaatcatttcaattgagatattttttctgtttactcaagtaaatataaagatgctttgattttccacaaagaaagagttgttatccctatttgaatttatgttgcttcaaaaacaaacatcttacttttagtatcagaagcagaccattctgttccttagggaagtgatattctttagtagactggtgggagacttgtagaatattaaaaggataagacaaattccagaataaataacagggaaaatttattttctgaactctaataactatgatctgttcctacagtagaatgggcattcaataactggaacatgaaggattggcctacagggaaagcccagggtggtctgggacctccctgaacctccagcagatctcatgagactgtctttaattatccttttctctctctctctccctctctcaggcctacaatgaacactg

SEQ ID NO: 111 - DNA, 112 bp, Homo sapiens
tttgagttatgtgattccttgtgtaagaaatcagatataagaaaacacacaggtatctgatcctttatggaaaaaaaaaatcaagaacaataaacaggatttgaataaactc

SEQ ID NO: 112 - DNA, 905 bp, Homo sapiens
taatgctttaaaaccaaaaataaataaatgaaatgggtctcttctattaagggttttctagaaacctccatctttccaccactctcctataaaagttttaaaacattttcaaaagccacttatcactattcttagactgccagtgatcaaaagggcagcctcgcgggttgcaaattagtgaagaagagaaagctagaaggaagaggaagtggagcatctgagggaaagatttttaaatgaacttctttgtgttgctaaatttattcgtatcctggaatgggctacaaccatcacaaggacataaaaatcatcaggtaaattcaaggactttttaaaaatgcatctaatcacctcctgtccaaaacattcaagcttaacctttctcttgaaaatgcaatctgctctttacaccctgcctgcataccagattctgagacctagattgccacaggagcagaaccatcaccttgtcctgattcaataggttcttgttgttacattatcagcttaagatcctggggtatgtggagatgtgcctattcattactgaaagagttcatgcacaatttatgtccttcacataactttgtccttaaaggctattttctgaatccatttcagttatgttttcccaacagccatattaggaggtgactgttgtttttccatattcaaagtaaaagaaatgagacaaatatctcaaaatgattgaggtgctcacaataaaaatgtagtggtaaagatagtaccagatctcgtgtctgtagcttctgtgccctctttcatagtccagaggactgagctactctagcaaatgggtatatgagaactggtgaccacagttaatccagctgacatgacaccagccattacattcaagtgcagtgatgtattttgcattgctc

SEQ ID NO: 113 - DNA, 4108 bp, Homo sapiens
atagcaaaatgaagaaaaattacaagtttctgactatgagtccaaaaatgagttaacatgtgattttatgctagaagataatctaatgaggtcactctgcttagctgcttagctaccgctgttatcccaatgggactgggcaagaatagaaccaagtcatgcaagtaagagtagcacctgattgggcactgggcttggattcaggttgttatctctatggatagctgtggttcactgaggaaccattccaaagatgttagaagagccagacagaacctacattaattcattggttaaagctcagaaataatcatgaggtctctgagacaggagacaattagacataggatggctcctattatacacaaaatttcattgagtcagctctctccgctttacttcttgccctagtatatcttaaatatgtggttttccccttgcctaatccaggagagctggatttcataactaacaagactttagacttgtgcttcacctttcagcatgcttctgggttccatgatgtcccagagcctatgtgcttatgattaaaaaaaaaaaaagaaactgaagagggaccccagtctgcaggagtgagatgggcatgggaagaattacattttctctggttcctgggtatgctgaagatgacatccaggagaaaacttctggcccctcaaactgccccatagctcagcctgcgggctgcgacttacagtgacatcagcaacatgatggattccatcgccagcagcctggactccaggaggcaccccaggcgtggccgatgtgcacaggtaggagcatgtcctctgcgtggcctctgcactggaagagcttcaaggccttttcctccagggctgaggggatttgtgtttcgcctctgtttgtttttgtgtacttctgtttggcgaaactttcaagcacgcagagcaacgttctgatagatagtgcagagaggagctgcgcagcatcctggagccgaaagttacaaggaagagaccaaaaccggtaaagtcacggatgttgtggcccgaacctgtaaatccaaacaatctcacagttatgaaatggaaaatttgtggggaaaaacaaatgctttggttattacagtgttactacattcataaaatgtatttcatttgggggagtttacactgggggtaatgagatttttgctttatgcgttatttataaccgcttaatccacgtactgtgggtttttttaattccttcattttcacagctacaaaacacttcagcatttctaatttatttctgcttacaatacagatgttcttagttgtgtttctaactatatttcaaccgttacgatcacgtttgtttgtgtcagcgcgcaagccggggttgtatgtgcaatacacaatagtaaggcttcaagaagcctgtaaaaaggcctcttgtgctttcattatcaacaaattaaaatatgctgcatggcactatctttatcatcagtggttttaatctttggataattcccctgcagttgggtaggcagagtgacagccctctctcagtgtagaaagactgcatgccttaaaatggcacttttcaagatgaccatttggaagcaacatttggagaacatttgggttatgtcctctaactgaatttccaagctgttggtaacggactaaagaaaatgtagtctgtactgaatattaaggaagcaagagtgtaagagccttgaaggtcatgtgtaaatattgacattttattttatttagtaaccaaattggggcccttgcattgcttatcttgccataaaaactcctcactcactttcactgccctgcagattgtcagggaaagatctgatctgagcagctctgggtgctcttcctgccattgctaacaagactgaattttgtttgtgcaaaatctgagtcagaggggtgttcctcccctctcatctccaccacggactgatgcacctgattagataacagaaatttgtgggctgaatgttcatgtagtgacatgaaagccaagatgcaaaaacagtcagagaaaacagcctcccactcactcagagtcaagtcaggtgtctaaaaccaaagttatctggggaaccaataactggctaatttggccagaatacccttctctgtgtcctcagcagcagtgtgaggaagaaataccagcatgtcctcaggccctgtacccttctcagaaaccaggactctacctgcagagcttaatcagggccatattctgaaggtgagatgcaggcaatggccaggtctctccaccagcagcagtggctagaatgccccacacacttaacaacttccgggacacatttgactgttgacctacaacagcattgctttcctctgccaaagcaaagagctctgctcatgtagaataggctggcagtttggtaacttgccagaggctcctgtctccctacagtgaggtcaccagaatcgcttccctcctgaaacacagtcgattgaaatgaaggtccagcagaaattaggggccagtgagttaaacatggaggccacttccaatggtctttagcctaagaggttttctccaagtgaaaagaagaaaattgaatatgggaataaaatgatcttttaatgcttcataactcaactctctgacttacctcaaaaagagagaaatagtgtaaaaaaccaacactgttttctgccctctaaatttgagttttgaaaggtgctcctcaaatattaatgatctggtttctgtgcccaaataaatgtcatgatttacaactcatgcttatggttgcaatcctaatcacccttccctacggcagctttataagtcttgcccagttccactactgaaatagtgcacttggattcaaacaacactcaaaaaccttgttttttgttttgtttcatttttaactattactgagtggacagggtcaatcccattcaaaattcccaagtagacaaaatctgtctgtggcccctccccttcccctcaccttcttggccgcctccctccattcccactgatgaacttccaagcttcctacagctccactagtccttttcaaccaatggaaaacaaagcagtttcctacattagtgtatctgccttcataaagtagtttagtgttttgcacaaaccaagagaatgttcattttaaaagcaggaaagaaagattacagatggaatgtcagacaccagggcacctggataaaatataatttggggcaggggagtatattctcatcttacctaaagtagacgaaccagtcaagtcagtacccataaggtaggcttgataaatctcaggaccaggcacctccacccccaacaaacacacacacacctttccactgtgatgttttaggcacagtgtattgtagctctgcctatctactcagaacctaatgtattcacatgaaagtaaactaacagagtctggctgtcctggtgattctcaagaccctattgcctcctcacttacccaaaaggaaaggagcagtagttttgttttttttttttttaattcaagaaatcagcaaaaaaaaaaaaaatgtgttagtgtttctccaaaacttctaagttagagtggcacaattcattttttttaataaagaatttgattaactctggttggcccagatttgcttcagcctaaagcccaacatctcttttgcagcgtggtatccttcagttgctcatacttgagccaatagaggtgggaggggagatggagaagactggttttatttgagcttgtgaaaatggctttttatcaagttcaatgtcataagttttcttccacaggaaagtagaatatattttctggtgagcaatagttttttattatatagaaatggttcctaattcttagcagacagggatttgagaaaacaggggagttctccgaagtcacaacaaataatgtgatggtcaacgtgatagactattgtacgctttgatagctagtttcagactgattttctgacacatgagagaggagcagtgcctgttgcccatggaaggcgatttgctgggaggaggaacacaaacatccccaaaggctaccaggtcaactgtcattttcaaaattaccattaaaagtaggctggtg

SEQ ID NO: 114 - DNA, 765 bp, Homo sapiens
attattattaaaagtaataagaatagaaaacataggctgtgtatgctagattaacaaaacattccccctacaaaagggggaaatttcaattttctatgaagtttgaaatctataatcatctggcattatttccaggcatgtagaaaaaaattcatttgtcttttcatctggattagtttgtctccatcagtgtgtacatcaaaagtacctggggattctgtgggtttggggaacatttttttgtttgcttgtttgtttgttttcaaaatatatggtagtatcccaccacaaatctatactaaaataaaatttcgcagtgtatgtcaaataaatgtgcactttgaaaaattccccaagtaaattttgagattggctcttgattcagtgacactaatataaacactttcacttacttttgaattttgtggtgaccgatcttaagatttgaagcctacaccttcttaacttggtccatgggggcacaaaaggagagagagtataaatgctgaggatgaccttaacaaaagtgaacacgaaattaagagatgtgaacccaaaataaaagaaagcaaagaactctgtcttcccttgtcatctttaactctgctctatcttgattcttctctgtgtttttcacaggctcttcttcctatacccactctgtaaagtgatttaccccatagctctccacccctttcaccttggatctctggtcagataatctcaccttcctctgtggcttcaaagccatatacatttgacttc

SEQ ID NO: 115 - DNA, 596 bp, Homo sapiens
gtgataatgaggggggtctagttattacaggctgcattccctgatagtgtgtccctgccacaggaagggcacagcagaggctgagtggaccactatcgtgcctgtctttggggaaatccagcataagcctccaaaatcccttttcctcttttaatttgatgacattaatgaaggaatatgagctcacagggattaaatcaagatgattaaaacaaagaagtagaaaatatgatcacacgtctacagtgtgtctacaaacacggcataatcagatatgagaaaaaggagttttgtgaaatgttagagtcacaccctccctgacgtgagcaatacagtggccagcaaggcaggagaggatgtgctctgtatcaagaatgtgaggcctacggtaaagctgaccggtacaggtggagcaagaccaactaagaagcatctttccctggagaaaactgtcactcatcaagaggatgtccatggcaatctaagtggagattttcccaaagggactacaaatgtcagaacccaggtgatctgacatcaatgaatcttcctgaaagccccttgggatgtcatctgatgacatgagttagcattgg

SEQ ID NO: 116 - DNA, 74 bp, Homo sapiens
aatttaaccatgcagtttaatttatgtaactgtgaattgtagactcttatttaaacatgtggtattaatattat

SEQ ID NO: 117 - DNA, 338 bp, Homo sapiens
gtggaggtattcatattccaaaataccactgggagatacagaggaataaaaaattaagaaattccatacatcagaaggacaagagctcttgaggttctttcagtggacagtggttttagacttcactgtgcattagttctgtccaagatgcttattacagatgaaggctctccttcactagaagccctccccatcactactcttgattgcatggttcagtaggacaatactttgaaaaacatttccctggtgagtgaattcaaaccctcagaagagggattccatgcttcatacaacactatggaggctttgaagtgtttaccatacttgggttctat

SEQ ID NO: 118 - DNA, 162 bp, Homo sapiens
atttgccaattgcccagaaggatgaaagcctcacagtgcaatcattgtcaagtcctgctgagctgtgtgggagctggcttatgtggaactgcctgagcttctcaggggcctcctcctggcacatcgagctcagatgaaatggaaggcctcaaagccccactc

SEQ ID NO: 119 - DNA, 67 bp, Homo sapiens
ttgttgaccatagttgcttctcaaaaaaagctcacctgttaagcttaacaataggtaccagtattga

SEQ ID NO: 120 - DNA, 251 bp, Homo sapiens
ctattataaattgtttttgagaacaacttaaaagaaagacatgtggctgttgctgcatgatggacaaccaagttttttgaccagaaaacattttgccccttgcagaaagaactcgggaaagcagcaggcagtctggaatggcaatgggaagatccaaaggcagcaaaggcttctctccgccatgtgaaaggcctgagtttagatacttcagggaagttttaatgccaaccttctgtaaaatccccattctc

SEQ ID NO: 121 - DNA, 838 bp, Homo sapiens
caggggaggagcaaaaagaaaaaacgtttattttttattgaaaagaaaaaccctcattctccacagccacatccatatttcagaattgttcttagaaacttccagaaacaattcatttactgtatataacattatggcctagattaaactgatcagtaattattaatgcttaacgttagtgcggaagctcaaaaattatatactagagtgtttgtgtaactctaaatcttaagatacatgtcagtgatacccgaagcttctttttttttttattttatagagaaaacataattgacaaaatggtcacatactttttaaactttgttttcgacatctttgggaattgtaaccattgaaccccatgttcctgattcaagctcctctgtgcatctcttaagagttgttgaattgaagtcataatgcctgggatggaagaaaaggcttccaaggggctgatctcacaaatcagcggataggctgaccagttactctgtttgttctcaggcatgtgaaagcgttctctggtcctaaacatcctgttctagttgtgccccatttgttgaggggttgagggtggcattgatgcagtctccatgctttaactaggctgctattacctattacctgcctgcctcagcttccaactaccacccaggttaagagggcatgtctgatgaagaaaccacctcccttagtcaagatgattcaacttcattctactctcatcccctttctccaggtggaaatctgagggtctgaggaggagacagagagagaaaggggacgcaaaaaggctcaattctcaggcttctgtcccaacaacatcagtattatcttc

SEQ ID NO: 122 - DNA, 672 bp, Homo sapiens
aaacaatgtagaaagactggtcaacgtgagtttcattattatccagaaagccagcaggagttggatgagctcattcacagagaccactgggttttaggagcagggatttttatccctctggactgggagagttgggaaaaatgaaaggatccaagctttaccaaattcagactcacattttagttcccagccaaaggtcatgttgaagcacagtgagaagcagtttccctgaggaagggggttggacttggaggttggttcccctatttagattcagacaatgggagggaagtttattacttttacagcatggtgacaatgcaatgcttggtaaaaaacagttctcaggacatttagaatttgttctctttccctgccatgtgcttatgggatgctcccataaatcccttctcttatctggatacagggacctattgactagtcctgctagggattgggatctggaaaaagcaatttttttctttggtttgtgcatttttaaaatgcctgtgcaaggactaagaacctgctattcatattcccaggaaaagataactgtatcaattactagatacggcaccttggtcatcaagagtgagtccaacgactagcaggtgtcttggtttgtgaggcgccccctccagcattaatgggaaaagagatgagggccag

SEQ ID NO: 123 - DNA, 1722 bp, Homo sapiens
gatgagggtccagagattccagtctaatgcctcactcctgggtcgatctcaccaaatagcaaagggtttcctgttcaccctttccatactggaacaagtgagaggtggaggatggtgaatcattttccaaagccagaattggccctcttggaatctttgtgcatttctgatggaatgtaggaaaattaagggaaatcgggaggctccagggatttagcatggttcgggccacagcacaaggtcccataggctctgaaagactaagctatagctccaatacaggcgttatctgactccaaagttcaggcctcttctacttgagatctgagtccctcacactggagcatggtcagttaaggctgcaaaagggagagagtaatggaggtcagcgttgaatagatacgaatataaactcttgggcactgttaacgccaaacagcctgacatcttacttcagatataactgtaacagtgtccaaaatccaatattagcatttaaaacttgtagcacacttattgtggagtcattgagtgatgcagaaagaaaaaaaaataaagccctgagaattcagctcatttacccaagtcactgacgcatttaaggaacagctcttataagtccatttaggtggtttagggctgcggaagatgcccagaatccctaaatagaaataagtactggtcatcagagcagtgcggttaggccctttctggccaggaggtcatcttgggctccagagccacttgttcagctctgatatctaaacagccaaagtgaattattcacttaggagggtgaaaaacactcaactccctgggattgtcaaatggagttttccatcataaaatatcttagtcatttggaatctaaccaaagtaaacgcctggtcctgacccatccatacctctgtgctggatgggaaaggagagagggaaatcccaaaacaaatggaaaagccactttgccagccacagagcatgcatggccctccctgggcaggtctactccaggtgagacacggtttgagccaggctacaggtgaggagcgggtcacgggagggctctaaatggcatctctgtttgattccaggcctgagtggggctgcggcttacataacagtttggcagggagatgcagccaggcggaagcacgcgggtttccagcagcgtataatcatctttgatttctctgtttgctcagcagctttcatgtggtgggggaggcagtagtgcaggaggaggggcagaattccgatacactgcggccttctgttttcttctgcaaaacaaacagccccaaacagatccccatggccagggaattagccactgccacagaagtcccgtggcagtctaggggaggagctgccctggagcctgggtcaggcctaagaaggtcagagattgacttaaagttacggtctcgctaggtgcacaggagcccaaagggctaccgaggagcaggggtcttggatgctggcagcacctaacatggtttaccctcttggcactgagggctgtggtgtccccttctgattacagaggttactgaatcccatactacgtccatccagaaaggcagcttgtcaggtctctttcctactaatcactgcctccataccaggctaattctgctggaatcctgagcatctgggagcaaccaatttagaaaataacatttcctttgactaaaatacaaatttctagctccttttgatcct

SEQ ID NO: 124 - DNA, 46 bp, Homo sapiens
taagatgaattccctgccctatcctaagtataatgatttgatagaa

SEQ ID NO: 125 - DNA, 25 bp, Homo sapiens
tgacagaagcacaaattggtcattc

SEQ ID NO: 126 - DNA, 386 bp, Homo sapiens
aatttatcatgggggcctttagtgcctggcacttagcacatgccgtatacatgtgattagattaaatgaatacataaataattcttccagcatgcaaactgttgatcttggcagtgaggttctgttaccaatgtgtccaccctctcaaccttatgaataggtttattgacaggatacatcttgttttgcaagtgatttgcatgaacttgtataatgttgtgctcagatatttccttacattcagatattttctaacccccagcttgcatctctggcctcatgttttgctactccctgccctatcagccatgaggaactgcttgtatgacctccctgaactcactctgctcctggggcctccacgcccttgctcaccctctcccctt

SEQ ID NO: 127 - DNA, 537 bp, Homo sapiens
accctagccaggcctgcacctgttttagcacatcagtgcacacacaccctcaattttgacactcccctgcagagtccagataaccaaccaaggatccaaatggattcttgttttggacagagtctagctctctgttgacatatcatgttctttcctctattatagtaactacccatgctctgtgtgttttctcaagttttctgtgtttgaatacatgaaattcttttgctctttgtatgaaaacaatgccatctgttcactagatagaaattctggaaagcttcagaaaagcaaccaggttttactgcagaacagtctaagatatacctcagtgggattctgggtgggaggcagataagattaggacaagaacaacttggagttcttagttttgtgtggttccctgcccccctttttttgattttagattttagaacttttctctcaaattcatttcaatgagattcatgctccagtgaaaactaacattcttcttacattccagcctagcagcctcaggggtgatgatagtcttca

SEQ ID NO: 128 - DNA, 37 bp, Homo sapiens
aaaatttaaataaattgcaaaaaaaatagtaagaatc

SEQ ID NO: 129 - DNA, 2161 bp, Homo sapiens
ctttgaatgtcaatttcacacattcagtacaaaagggcatgctgatatttatcctcattgaagctgttgacctccttcaagggcttgtcaataccaggactgctcaaaatgattaaccagatgatttggactgcactggaatttgattagtggtaatttgaaacatccaataatatttgccttgcctagtgataagcagatacttggcaaagaggatggagtacaagccttgctttatctcagaacacagacatcagggactgtaggaaagaatgctctagaaggaggtcccctccctggggcaggccctgtgttggaatggaatgcagatttcaggtcggagaaggcaagtggagaaggccactgtccaggtctgtaggtgggacagacacagagggctggctgtttcccttgatggttctcaccagtagccaaaatcagggatctaaaacagagtcttttaacagggctgctttatggaagagaggggctagagtcgaaaaccaaaactgctccaaagtagtccaaagaagctaatatggaaacagccatttttcatagacttattcatttagattaggatgatatgaattgaagaatctttttttttgatattggtcagagacttagtgtaagaaaattgggaatattaaaaagaaacaacattgtgactggtctatgatttatattactaatagtaaactgccattgctgaacatgcttagaaaacattttaaagaagctctgtagaacttaggctacaagactacaacctgtatcacttaaggaagttattatgctcataacattgccaactgatggaatgtgcctctgctgacttgtacccaggccagcccacaccacagactgcagtcaagtcttctctgcatgtcttcatcagccccccaccctctgtttattaaggccacagtggagccagcctggaggaacagggctaggaaggagggcgtggatccaggaacccagtacaaatcacatgcaattcctcactgtctctaatttttattctccagtgaagatcaatgtaggagagaaagataaatgcaaggagggcaccttggggagttaagggaaagtaatggtgctgactgcatgctctgggagttgttgtcttctcatatctgtgctagcagggcaattttcttcttgcaacaccacattcccctctaccttaacagtggatacctgaacagtttattttgccatttaaaaagatgcagaatactcctctcaatccttcaatcatacagattacaggaaaaaaaaaaagagattaatacaagtagaaatgagcctcggttttgcctctggtgtgtcactgtagaggaatcacctctttttctaagcccctctattccctaggcagcaccctaggctgttgaggctacacgccagctggtgcagctccacagtaccattcctatttgacagatctaagaggatcccaggtatgtaataaatggtcatgagaggttctgctgactgtggacaccaacatacttgcagcttcattgaatgctctagaaggaggtcccctccctggggcaagccctgtcctggtaatggaattcagactgcaggtcggaggaggcaagtggaaaaggctgctgtccaggcctgcgggtaaaacagagaaatggctggctgcatcttccctttctctattttctttcctccagtgtatacaaagtgctgatgtaaaattttctgatctccatcagcaatcatcttcaaatagcaaagtggagaaggcagcaagaagggcaataaacccagggaaagaaaagaaagaagtcagcagccatggagggaggctcaagtgagtggcaggggtgatgagaaacctggcctccaggtagagagcacaatgtgaaactgtgcaggggaagtcagttttctaaactgaaggacacagcatatctgttttgatgatgttagtattagcctatccctggagatgagagtctcagcttaggcctcttacagaaagcctggtaactggtggttctttgggaatcccagatgtcatgaaagctgtcttcaaactgagagttaatcgtagtctcaaatttgatgtcccttcccaatcctcaccatgtgggttagcttgagatcttttcagaacataaattcttgcaaa

SEQ ID NO: 130 - DNA, 1512 bp, Homo sapiens
ctgaggctccagtgaatgaaggtgaagcttgtgccagtggaaccagggttggcatttttctgtgcgtcatctgtaatgctctgctcagggcaggtgtcctcacaggttaagtaacaagcggaatgatgcaacaaaggcagtactactctctctacgtctgtcactaagaggctaggttgcaaaacatggatctcgtttcaatatctgtttctttaggcttcaagaaacaagatctaaagcttcctttcctagtattatcccaggcacctcccgggcctgagctcaccctacctgcacgcacagcccttcggaagaatcttggagagccactgccaaagtcattactgctatcctcattctgccccatatcgtgaatatagcaatcaaaggggcacctcatgcatgatcgggaattttccctgcatccaactcttaggagtacgtgcaccagaaagtgggctgaccaaggtcgagtgcttattagtttaataattggaacacccgtggtacttcctgccaagtgttcaaagacatgacaataaagtttttccatttggcactggtggcttgggggtgaaccttgctggtgcacacagggctggagttgaggagctggaggtcaccctgacccctgctcctggagccatcacctccttgtccatgatcatcagacttgcatttccatgtgaatgagccaagggaagaagtgtttctgagttttatgggccttttattctcttgttttctttaaaaattggaccaggaactccagccctttcagctttcttcctctccctggagtcccactggtgcacattactgctaatggggctttgcgcctgccaacccaaaaggaagaacaggtccgcggtgcatctgtggcctaatgaggagccttgaatggaaatgagagtcaaacatgcattgaaaatattcagttctcagttggtcatccctcccccgcccctcgccatctcaaggtccccgagccctgtgccagcagaaggtgacctgccaaactgatatcccgtgaagcttggggaagggcactcaaacgggacccagaagcacaccctgaacttgttttttctgtgcttagcactgccaaggcaggggctgaagcaaagaggcaagcgggaacaggagcagggtttgcctactgagcagaaaggaaaatcaggggaatagggagctgggagtcagatgccaggtggcagcctgaaaacccattgttaggaagttcactctgagcggcgagtaggaacttttatcttggcaactttaatggagaaagaacagggaggcaggtagcaggaaaaacatgggcccctaagtcaggagacacagtcccaggcctggccctgggacacataagctgcagcaaaactatgacaatttggataacttgttttttttgttgttgttgttttttttttgagccttggctccctactgtgtaaaataggagtggtaagccatgctttacctgctccccaagcacattgtgaggac

SEQ ID NO: 131 - DNA, 150 bp, Homo sapiens
tctggaggtggtgaggctggctaagcagtcagcaaacgggcaaggtgggcatgagagtgggggacccccaaacctgcaagtgttcagctaataaaactcagcactccatattacaaggcagttgttcaaatcaaagtgaatggagtagct

SEQ ID NO: 132 - DNA, 131 bp, Homo sapiens
acagtccctcctcatctgaacctcacctttccagagtgggagagaattttgtccctctctgctccccacttgcccctggccccggttatctctgggcatctctctttttcttctcttttccttttctttcc

SEQ ID NO: 133 - DNA, 96 bp, Homo sapiens
atctctcacccttttgtcccccatttgaaactttgccaccagcctggtcctggccacaagcagggtcacatgttttcctgtcttacttcatgcccc

SEQ ID NO: 134 - DNA, 61 bp, Homo sapiens
atcaccccttgctttttgattgtgcttcagccagcgcccctcccgaggcaggtaaaagtgg

SEQ ID NO: 135 - DNA, 38 bp, Homo sapiens
ctttaagttttatggtaaaagtggtatttaggagactc

SEQ ID NO: 136 - DNA, 549 bp, Homo sapiens
gttttttttaaatgttaggcattaaaatgaaagacagtaaactcaagagctctgtgtatgtaagagtgagaatggggtggcagaactgggaaggggcctaaagtaggtgagtgcaacgaggcaaagtacagcacatttctgctttcctggaataagtctgtaagcagccacagctctcccaaccctgccccaggcccgctgtcctcagctatgactagcaggagtccagggtccactgctgggagcccacctcctccatcatgtcttgctggaatcccgggggcttatgcaggcctgaatggggctccctgagacttctgtctaaggaagccatgcactggccagcttcatggctgtggctgctctttccctctctgacacgggatgcttttgctgggtgatggccccttaccttggcttctgctgttttcttttccagcaaagggtgcttctctgggtggggcttcagaaagaggctggccccatagtgcctctcccttctaggatccgctctgccccggtagtctcttttattctctcagggtgcaa

SEQ ID NO: 137 - DNA, 512 bp, Homo sapiens
ttgttcagtgcctgctggtggacctgagaggggaagagaaggtggggtgctgaccaactgccttcatttatacttttgccaatattagaggcagatgtgggtctggggtctatttaggaaagggaaaaatgtgattcctttttccaactgtgtcccccctttccctaaccttcctttcttgtagggtggattaacagtttttttttggcagaaaaacacaccaaccaacaaatgaacaaaaatcaacaccccaagctatgcatacaaaacaacaggcccaacccacacactgagaaatcggacactcagcaggccactctgccaacatgctttgaaaggatactcttaagaggttttggaggtagggttaacctccgaaggggacaatagggactgatgtttgcctcaggctggtagggacaaagggcattgcagaggagaagacaatggaagtgagccttgtgggcttatttggtggctggcagcttgaaggtttctccctctagggcaaa

SEQ ID NO: 138 - DNA, 300 bp, Homo sapiens
cagggttactgtcctgcttggtgacctgcctactttgcccaagaaacaagttgaaaacttccacatctcgggaaatgcccaggtcaggctgcatcagggctgttcctcaggagctcagggacaaagtgaaagcaaaggacaccaatgctgggtgcttgggacagtgtcctgttctcctcatgtggtggtcagtgccagtacacataggcagttttctgcctttaaataagataacataagaagctgtttgtaaagtgtaaagaactgagcacgcattaggtgatttcttttctttttttc

SEQ ID NO: 139 - DNA, 117 bp, Homo sapiens
gcatgaggtgatttctaccagtgaagggtaggtgtgggtgttttgggcctggctgttctatctcagggcctaccattgtcgtcttgttcacactccctgtgctgattatgaagctga

SEQ ID NO: 140 - DNA, 82 bp, Homo sapiens
aattggcagagcagggacttgcctcttcctgggactgcttcttgtccctgtgagcatcaccccaacaatgacttttcacctt

SEQ ID NO: 141 - DNA, 887 bp, Homo sapiens
acatgccccttggaggcattgcctgagaagcacatcagggtgtagccttacctctctgtgctgctccgaggaccctgatctcagaaaccctgccagtggccccaacatgtgaaccatcgtggtaaaagaactctctgatcacaagaaagtcccctaatctaagataatgttgataaacaagctaactccaggagggagggtttaatttaagaaagccagtagggaccctaaatcttttcattccaatcaaagctgtcaaagccagttatcgtcagagccagtcaggtggccccaaagccgccatctacctggcagctgtcctgtcaccacggaaaccacaagttggtgaacaaggcccgaaggaaccctgctgaaactcagttgcttgacatatttgtcattatcgagtctgccagagtgcagcatctcttgcaagagtgattctctgaaacttctcctgcttcaatccctctacccattgtttcccaaatagagaatatgcccacctctgagaaagacatgtgctggcaggcatcacaggcccaagaggaggcacttgtttactcgacaacagacaaggtgactgtctgctgcattggcaccaggactagcattctttgggcatccccaactaccttttcaggcccccgtgtcttcaggctgtctaggtcctggactggtggtcgtcaagtctgcccaccctcactatccagcagcaccagtggagcatgcttcataactaccctttcctctctccgaattgagtttgatgtcatcaccctgcaaacgatgaaacaaatccccattttattgatgactgataacttcaaatgtgacaagaggattcatttccttattcaatcattccacaaatattcactgagcat

SEQ ID NO: 142 - DNA, 87 bp, Homo sapiens
atcataataattttcaggttatggataatgccaatgggcacttaggatgatcagggagggcagttctgagaaggggcatatgagctg

SEQ ID NO: 143 - DNA, 23 bp, Homo sapiens
aactatgacctaaagaaattagt

SEQ ID NO: 144 - DNA, 309 bp, Homo sapiens
gatgtttcaaatcccttcaagctgggaaattctgtctctgttgcatctttgggataacaaacttcctgaagaatcactgtgtcttttcaaagactgaaaatggattcccagcaatgtgaaatcttgtgcctgagtcctaaagtgatcaaaggtaaggttgagcctaggacaaaatgaggatcccctggagggaagctagggcaacacagtaagtggcaaaagaatacgagtgaggttatttgactatcctcttccagtagggctggctcagctatggcagaccccagggtggttaggacaaatggcagc

SEQ ID NO: 145 - DNA, 116 bp, Homo sapiens
gatgaacagtatttcctagtttaatgtttttttttttttttctaggcagacttttgtagtgcacagtgaccggtgaccagcagcatgtgtttccataggcatcttctctcagtacc

SEQ ID NO: 146 - DNA, 37 bp, Homo sapiens
gtttgcgttttgaaagtgaagaattgtcgaagtgatg

SEQ ID NO: 147 - DNA, 116 bp, Homo sapiens
acactctaaatctgtggtagaaagaactgttgttcccaactcctagtttccccctgtaatagggtgacacagccctgcccatggtgtgacttgcccattctccctgaagggacacg

SEQ ID NO: 148 - DNA, 342 bp, Homo sapiens
gggtctgctctgtggctagggctgtggccactctcccattcttttccctggcaccatctcaggtccaggaataaagaagagcaacaaaagttttcattagactttaaaaactttgagtcttactcatatttaatccttagttgctgaagaagtgactttcatatataggagaccctaagggggtacattctcagtgaagtgacagccatgggggagggaaagattgatccatatgaggacttcaaggtcctggcatatcaggacaggtctttaggagtcctgttgacataaataaaataggtagattattgagactgaggccaggccctaaacactagtgta

SEQ ID NO: 149 - DNA, 708 bp, Homo sapiens
aaactagaattaatattcctgagaacaaggggtggcaaagcctcctccttcatctggggtgaggggagtcttctgagtagataaagaactccttttagggtagaaaggagctgaagttcatccagtgcaagtactgagtgaatttattctaaggtcccaagacaagagaaagataaaaacaaaaacggatgtatcactgaaggagatgtgctcggccagcttccggcagcagcaagaacagtgggtatataagctccagtagccaaggttgcccaggttacccttttcaggggcagcagtagaggcatagttggttccggagtcagaaagacccagcatcttctgctgatgctcaagctgcatgttttttttcaatcttcgcagctacaaatttttatcccaatggggagcactgtttataggttggaggattaggttccataggaaagaaagaaaatgaggagagacacattggacaagttggtgggagactgtgccactcgccctctagcctttgaccatagacaaagattaaataaggttatatagataggaagaaagaagtagagggggcaaagaaccaggtagctgactcatttaatcctcccaaaagggtttttcttattgcagtttctttgcaactctgaccatattgtaatattaatcaatcaatctatcacttgcctttgttgatatttctgtaccctc

SEQ ID NO: 150 - DNA, 102 bp, Homo sapiens
ctctgtctctcctctcttcctttttgcacatgcacaaagaagaggtcatgtgagcatggagcccgaaggtggccatctacaagccaggaaaacaaccctcat

SEQ ID NO: 151 - DNA, 133 bp, Homo sapiens
aagccacccagtctctggtattttgttatagcagcccaactggactaatgaaatttatttaaattatatttcccccattagaatgcagaaaccaagcatctccatttcccaaataccaccagtacctggcatg

SEQ ID NO: 152 - DNA, 20 bp, Homo sapiens
ttagtaaatcaataacataa

SEQ ID NO: 153 - DNA, 323 bp, Homo sapiens
cagatatgaaaggatgcttaatactcacaacctagggacacaaatggcatttccttaaccaaagttagttgaaagtgggccaggataaaataacatcttcagacacaaactacattaaagattgctttagctgatccaagagaagggtcatatttgttccaatttcagtctagtgtcctctctgtaaaagggattagagatttgccaatccacatctggttcactccctgtaaatcaatgccctcagagtcagtagacagacacaaagcttagaggaatttaattgccaaaggcaatgtggggatatgagaggatgagcattt

SEQ ID NO: 154 - DNA, 227 bp, Homo sapiens
actcatatttgtgaaagttctcacgaaactcttcaatagccaaatagatagatggcttcttgtagttctatcttactttatttgaaagatatatttgagaacacttatcagagactctatgtctcatctttgtactgtgcccaaatcacttactttctccatttgtagataatctccaacttaattactacttgttgatttttgaaatttgctcattgagtaccaca

SEQ ID NO: 155 - DNA, 21 bp, Homo sapiens
tggcaatgtgatccataacct

SEQ ID NO: 156 - DNA, 129 bp, Homo sapiens
ggtgtaataatggtaatgtaggggactgtctatgctccagagatgtaggcagggtgtttcgggttgaagagttacaatgtctgaaactcggtgttagatgattcagccaaaaacaaacaaacgatgtct

SEQ ID NO: 157 - DNA, 111 bp, Homo sapiens
attatgtattataataagtggtttgtaaatgtagtggtaagaataaaaattgagcaatatttactaaaaagtaaaatttgagaacctaggagataattgtctcttgggaaa

SEQ ID NO: 158 - DNA, 130 bp, Homo sapiens
tatcctagagtttgatgtaaagtataaatgtactcaattttgtttgctctctcttcttaggtaaaaagacatcccttaactatggcaaaacaacaacaacaacgacgacaaaaaacaaaacaaaacaaaa

SEQ ID NO: 159 - DNA, 154 bp, Homo sapiens
cctgcatcaatttgataaataatcctccccgttgatgtcactggtttttttctgcacatcttctcactgatatttaaatgctgagcttacactttccatggacatgcttaatgactaaacaatagttgaattctaaattaatcaactgaccaac

SEQ ID NO: 160 - DNA, 419 bp, Homo sapiens
ctgagtggtatacacaaagcaattgaggaacaacctaggaccttgtagtccattaggatttccaaaaatagaaagagaatggaaagtcacctggctaggagaagccagtggaaacttgacacgaagaaaaaagagcagctaatttcattcctgtccaccagttatttatgtgtttatctttaattacatttgtttgatttcccttattaaagtctgatgtcttaaaaaagcagaaaagtgaggcaggtcagcaggggatgtaagttgggaagaaagacaggtgagggcaagaatttaggcaggagccacagtgttggttgtgcaggtgaaggtcaggtgacggagggtaaccagtcatggatgacccaggcaggagccataaccaaaatgttagaaaaagttggtaagaaattgttcca

SEQ ID NO: 161 - DNA, 607 bp, Homo sapiens
gttttccaggaacaagggcagaacttagctactgagttctaccgaaggccaggatctgagtcaagcaccaaggttaactcccagggaagccaaatgttcataaaaggaaatctttccaaatcacaaatatcagggcctgctaggtaaattctagcttctctgtgccaagggctgtgttcctactctcaagcgccactcactgactgtctgggtggtgctgtgggcttctgtacttttagcttcatcagctgcacctgtcctcttttcccataagacgccaggaccctcagaatcttccctcttaccagaaatttgggttttgggctgggtccctggaccgaattctgacactctaagtgtttgcagactattttgatagaggtagtgattatgatgccagaaaagtgaagccagtttttattagaatgttggccatcttgaataatccattcccccacttccatgggacatcttcaaagagatttttaaaagacaaatatgatctctactaatgagatatcttcagaaggtagaattaaagcaaaattaatgtacacagaattcctatttcaatatatttattattcacaacatttctacacacaca

SEQ ID NO: 162 - DNA, 400 bp, Homo sapiens
tttctgtttactcagataccttcttgccacataaatcttcctagctgacttctgaaagaaattatgcaaatgttagcagtaacagttctttaaaatttgctggtatctgaggagaatcattgtccagagacactgtgttatttgtgatacttgaagtaaggtgaaaactgaagatgaaatgggccaagtcccctttcttttccatagtggtattttagtattatggaattgtgtggttttatgggatccctagtagccaaggaatttgctggaatttgatgggtagctgaatcacacaggaaatcagtaaggctgaaaaaaaaccaatcatatataaaaaattatatgcttatatgctaggaagagcaaatatatgtatatacacaacaagatattctag

SEQ ID NO: 163 - DNA, 333 bp, Homo sapiens
gggggccttcttctgtgcgtttccaaaacaaaaggacaagtgcagagattgctgcatttgcttgtgtcagctcaattttctttaaataaataaaaagttgagaaatcaggaaaatttagctgcaactatgagtgtgtttgtgcttacagcagaagattaaaaaccaatttcacacctgataaataggtacaactaatctgttttcacaacaaagatttcaaaaaggtcttccttttcgaaggtcaggtttattttgcaaaggtagagatctctacatacattcttgctttcttagcagtggtttatatcgaagaaacatacagaggctaaaaa

SEQ ID NO: 164 - DNA, 41 bp, Homo sapiens
aatggtggtaataacaatgaaatacctgctacctaaacatc

SEQ ID NO: 165 - DNA, 204 bp, Homo sapiens
ttttctgttcggactctgtatgacataggaatagtataactcagaaaaaatgtagtttcaaaacttccaataattctctgatttacactgttattaactgaaactgacctttgggcaaatcatcagttctgggaaatccacctgaaaggtcctatcctcgatatgcaacggtaaatgaagatattactctaagaagtctcctca

SEQ ID NO: 166 - DNA, 196 bp, Homo sapiens
aggcttcagattaaattatgacaatccagagagaaaggactggcatactttcaatttcatctagagagatggatgtgtagcaaatttccaggaagtccaaggtactgagtgactctgagttctgagatcccagaattgtgagagatatagaaaagcctactactagatgagaaaatctctctgtttctttattcac

SEQ ID NO: 167 - DNA, 163 bp, Homo sapiens
gtcactatatatgtgagaggagtactttgaataagtagtcccaaatttggatgatttgggtagcctgggaattttcagtctgtgtaagttatatatatattttcattcagcccatttacataacaacgtctagggatcagagatttaaaaatgaaaacacatg

SEQ ID NO: 168 - DNA, 23 bp, Homo sapiens
aaatatttttaaaatgtatcctc

SEQ ID NO: 169 - DNA, 42 bp, Homo sapiens
cactttgttatacattcttatttggaataatttttcaataac

SEQ ID NO: 170 - DNA, 39 bp, Homo sapiens
gctcttgtggatttgcattatcatctggtttaattgatt

SEQ ID NO: 171 - DNA, 669 bp, Homo sapiens
tggttttaataacttgttgttaaaaaatcttgaaattgttttatatttcagatattcacaaaagttatagaagaggggaaaatgccaacaaaggcaatcatagaagtagctaataataagaagaacttgtggagcattgcagtcacagagtttatattgtatttctgaaaatatacagcctgatttcattagcatttctctgttattcaagaagcctcagggtatcataagaccagattgttataataacatcaactaacatttgtgtggcacttaacaatgttagtcttttcatttacataatcttgtggtttggtataatactaaacttacttaagatggagtgctaaaggctttgtcatctctgcctcaactttttctacctttgctttgcatacagtattgaaaaagtgaatctaaactctgttagagaagaaatgactatgccttcattcaatcatttgttttccctttataaagcatatggcttattaatatttattaaggtgaataatgtgcacattatatgtgagtacatgtatgatttattcattctgtactttgtttcaaaaaatataaagcacctttcaaaaatttgtagagcaagataaaaaaataagaaataaaaagaggcaaagggaaatgtcagtgtagaaaaataaaatgacg

SEQ ID NO: 172 - DNA, 49 bp, Homo sapiens
cctaaaatatttacttaggagcatgattattcctaattctatgagcctt

SEQ ID NO: 173 - DNA, 65 bp, Homo sapiens
gagaggtcaacaattttaagagagaattcaggatgaactggagataatgaagttgactacaggct

SEQ ID NO: 174 - DNA, 29 bp, Homo sapiens
aaaaatacttttaactttttttggggggg

SEQ ID NO: 175 - DNA, 31 bp, Homo sapiens
actcatgatacagacaacaatcttgagttac

SEQ ID NO: 176 - DNA, 80 bp, Homo sapiens
gagctgtattagggagggaaaatagagttagacacattttcctcctaactaaagaaagactaccatgtactgaaatagac

SEQ ID NO: 177 - DNA, 378 bp, Homo sapiens
catcagaatttaaatgttagtttgttgttgcttcttattctggggataatgtatagtgagcaccagaactaaaatgctgcattgaaactaactcattgccctgctgttgtttcccaatctggggaaaacttacagtgggcactgaaacttaaatgctgccctataactaaatcactgccctgccattgtttcccactctggggaaggcttaagcacatactggaacttaatcccgatcttttagttttttcaggtcaaaggaaggctccttgcagacacctgagctttgtagaaaatctggccaggcagctgggccttcccatggattgtgtctcctgcagtactatggtgatggccagcctcttcagtgtggtgtgt

SEQ ID NO: 178 - DNA, 181 bp, Homo sapiens
gctcagtttttccttccattgattttcccatttctcctttttcctttagataagattttgaaggatgaacaatagttgttttgtttacttggcaagtatcaggagtgtagctagtatgtgtggcaaatatggagtacagtcatatcaactaaactgtgatagaactacggtccatttaaaa

SEQ ID NO: 179 - DNA, 51 bp, Homo sapiens
gtatgaggcagaatgtgataataacaaaagtagctaaggtttcttaagtaa

SEQ ID NO: 180 - DNA, 209 bp, Homo sapiens
taaaataggatgagagacttactgatgagatgttactcattacacttggacaagtacaaatgatttgcttggcgccaaagccaaacaagaagtgggttaattgtaaaagtatccaggactcttatttaacctaaggaatactaaacctccattgcagtaaactgaaaaaatatacattgattttgcagagccagaccttgatttcatgc

SEQ ID NO: 181 - DNA, 1168 bp, Homo sapiens
aaacctcctggtgagtgcattcaatttctgtcaagtatttttgtgactcagcatgcagtcaatagtcagctaagattcagaagtctccttgccaatagggctgtcggcattgtgaggacagttgaaagggagggaagcctgtcggataatcagatgaacctgtttggggcataaactcctaaactgtggtgtgctgcttgtggttaacatttatttctcagggaatagttaatagcccgttgtgctttgcttcaataaataatggaaagaaagaaaggcagggacaaaaacccggggctggatttagagagttctaaacctttggtttgacagagcatattttttacactttttattctagaccaggtaagcttttacaactataaagcaagatgcttacatcagatgccaaattgtcccacctgattctttatgccagcatctgcagatgcatttaaaaaagcttcatttgattatgcagcttcttcacagcccaaaagccaagcaagctgtgggctagttgtaaaggtgtccatgagctttgctttatctaaggaatactaaacctccagtgcaataaactgaaaaaaaaaaaaagttggttctacagagccagaccttgatttcatgggggaataataataaggagaagaagaaggaaaacttcctggtgagtgcatcctacttctgtcaagtatttttatgattcaacatgtagtcagtcagctaagagtcagaagtctcattcagctgaaattccaaaactgaataatgcatagtatagtgtcatttactggaaaagagaggcttgtttatttcctgagttttacactctttaatgtactgccccagaagttttcttttttggaaaccacaatagaacactaaagaagtgtaattcagaaatgtggcagataatttgccattctattttctagaacatcagctctttttcagctagtaaaaatggcttactaagtaaatcagttttggctccaaaaattattcagaggaatccagttttcttcctccctcactaaataaacaatgagaaagatagataaaatatcagtttggagaaacatcaaatgattagcttacataggctacctttgcatttcagctgtccctgggtggccccaggaaaacaatcatatctgaaaatgat

SEQ ID NO: 182 - DNA, 83 bp, Homo sapiens
tattttggttatctgttttcacggtattgctgcctgacaggcaacaacaaagtctcagtgcattcagcaatagacatttattg

SEQ ID NO: 183 - DNA, 333 bp, Homo sapiens
ccaactacataatgcattcacttctttttcttggcatctccctttccaagcacacccactctcctggtttccattatctccctgcagacaactctcaactggctctaagaaagctcactataattttcagcaacctaattcagtcgtttgtccgtcacaaataacagctcaggaaaatcaaaggattttctcactagcatcttatcattccatgtcacctagcaactatcccagtgcttgatattctgctactagaaactccctactacacagataataccactggaaggtataaagccacttgactgacctctctccattcacagcatttat

SEQ ID NO: 184 - DNA, 179 bp, Homo sapiens
ttaaaaaattaaagaaacatttgaaatcaatgcaccagaggctagagacagagtgctaggaagggaacaggatggggacagggacaccagagcaaagatagagtcaaagacacatttccaaaatggcaattcatgccttgtgtcagttgtacccacctcacattctttaacacttaagg

SEQ ID NO: 185 - DNA, 28 bp, Homo sapiens
ataaaggtttttttttttttttttacaa

SEQ ID NO: 186 - DNA, 57 bp, Homo sapiens
gttttctaatcagcaagaatattagttttattttgcttattatatatttgaatttac

SEQ ID NO: 187 - DNA, 196 bp, Homo sapiens
tgaaactatgttccaaatcctcaagtaaatctgtttaacagatatgacaaatatctgtcaatattattatccaagtgcttaaatacatctgataatctacagttaaatatgttttaatctacagttaaatatgttttcccctggtacctccttctttgagcccttgattctactgctctaatttggttgattgatt

SEQ ID NO: 188 - DNA, 43 bp, Homo sapiens
ttctgggcattttgacaagatctttcaacctagaaatacggtt

SEQ ID NO: 189 - DNA, 83 bp, Homo sapiens
cttttgaaaaatatggctatcctttttgatgtcagtctttttggtagattttttattttattttgaaggctatagagcaataa

SEQ ID NO: 190 - DNA, 333 bp, Homo sapiens
attccaagtaattttaaaatgcaatactatgactataaaactgtagtgggttatactccaaagacaaaaactattccaaaatatatttaaatagttttcagtaatcatattgtttgtacaaattgatactgttattctaagttgtagagtatgtattcctacataaaacaaatgagtaattatatgaaattcaaattctatcatcctcagtgttgttgaaatcagaattttcatcatgggagaaagggcacgatagaagagattaaataaaagctctagtctgaatttaaattgaagcatcattttaaatttgtcatgtattttatctttttt

SEQ ID NO: 191 - DNA, 24 bp, Homo sapiens
cttagcatgagcaattgcttccag

SEQ ID NO: 192 - DNA, 251 bp, Homo sapiens
tctggaaaagtcatcaggaaaacccagaatatggcaaagcctgtcagtggggtgggcacaaagatcttgactttagttgatttcttctgctctcagtcctaagcttcaccctaataattgggcctgagtctttctagagtttggtgagacaagcagcctgctgctttaggctatctttgtcctcaggcactcacacaaagttgtccattttctggccatttctccatctactttttttttttggtgtgtaa

SEQ ID NO: 193 - DNA, 250 bp, Homo sapiens
tatacatatataatgtatatttttgtacagtgcatgtgtaacattgcatatatatgcatatatatatatgctgtgttgctctttgtacagtgactaacaacagataatctatcaatatgttactacatcatattatttgtgcctaaacattcattactaagtacacacgttaaaggatgtaaaaaacacatgtactaagtacacatgttaaaggatgtaaaaaggatgttttcttttttggacttttaat

SEQ ID NO: 194 - DNA, 843 bp, Homo sapiens
ccaagaggtccagaggaagtcagagtgttgggacatcccccacccacaggggagatgaaagcttttcaaagattacaaagaggtctgttctgacagcatagggagtgagcctgacttccagtggataagagtgtgtgtttcccatgggacagacaggtgaggactctgggttatcctggagcaagagccgctggaagccagggcttgacaggagtcattggtggccactgaggagatattgtccataacagggagctgcagttggaggtctgcagttgggaatatgcaaccctggagaagccaaaggcagagtcagtggggaagacgggtagaagatcaaggtagggagaaataatgaaggaagtaccacagtccctttccctattgctgatctcaaaacatgattcacagcagagcttagaaaggggggaagttttagtttgtgtaaaagactgaagtttgggtatatggtattgaagttttagaattttgaactaatggaaaagttctggaatttgcctgaggtccatccagtgccatagaaggaagattaaagagagccattttaccagaggatggtgaaaaatacagtggcattctgtttacacactacttagttcaggtcagtttcatatattagtactatttcttattcatgggttttcatctatgtcctattatctgtctcttcatctatatgccagaagtatactgtgatgtccattgtaactttcaatgatgctctaatatttggcagattaaaaaatagtctccatttgataatgtatgatcttgtatacagtacacccttatctcatacaaccctcaccccatacatgcaag

SEQ ID NO: 195 - DNA, 897 bp, Homo sapiens
ccccttattaatcttttgtcaagaacttcacagatactcttgtctgtttatttctctgtattaccttagtattagtttgccaatgtatttggctgagcgagtaattacctgatcaagtatattctctttccaggttctctctgccagaggagactcttcttctaagggacatttattttttttacatggtagtcactccagataggcagattgtcacactagtagggaaaaatgccccatgtattttcataccttagtctcttcattagttccttcctccctgggttgtttccttataacatttgccgtctaaagtgtatcatgatttttcctcaactctgcagtgcttatattattttccccacattaaacatttggaattaaccattcccttaccttcccacttccactttttcaaattacccctttctttaaagcctaattcatgtttcaaatgctccaccattatcccagtcaacagcaggcatcttttcagtctgaatttattgtgtgccgcttgataatgttaggagccttcctgtgattttatgtttgctatgaaaagcatggctctatctcaagggctcttagtatgaactgatgagggtgggcaagcctgttatatggggtgatgatggaatggggtggggtggacagatcaacttttgtgataggtgtggcctgacagctaactctccaaattgtcaacagtgaagtgtgctgccaacctaagcctgattctagccagcatctatccccagggctgaatggtcatgccgttcacattcatctatgctcaatgcagccagggcaacttggacatgtttcaatgtactgaagaattaaatctccccatctctcccttgattccaggatggaggcactcgggctgtcagg

SEQ ID NO: 196 - DNA, 97 bp, Homo sapiens
gtacaaagtcagaagttcatgactgcagtcatggactcacagcccaaggaagtctttctgagtcaaaggagacatgtagaagagcatttagagcaag

SEQ ID NO: 197 - DNA, 135 bp, Homo sapiens
tttgagaaacccttctttagtgggagggcaaagaagctgagggaatcaggactttcactgactgggctggggttcagggctgagagccagtaataataggaataaggacaaacaaaacaaaacaaacaaaacaaa

SEQ ID NO: 198 - DNA, 233 bp, Homo sapiens
gcctgaaaactacggcagagggtgagttggatgtatagattagcagcagcagtagtgtcatgcagctgtcataagtgacagcttggggagcttggctacagaagatgattcccagagccatttaaggcaaaggaacgcctacatgcctgtgatggactcagagtgaacctgcaggtgctggctactactggctgagtgaaggaagtcaatagggttgaaagtggcctttaagt

SEQ ID NO: 199 - DNA, 1553 bp, Homo sapiens
gaaagacagaaagtggactttcagtatttcctaaataatttcagggtagggactaattcttagcatgtttatgttctccataatgcttaaccaagtgtcctatatttgttcaattactgcttattaattgactgattgatggtgtccttaattggtcatgccatttccatccacctatgctcagcacagccaggacaatttggacatcttccaatgtattgaagaattaaatctcccagtgaggatcttggcaatcatatcaccaataggcttggattcaaatctgcatttaaatagcaatgaaacaaacacactccatccctgtggatagcaagcagcataatctgcttacttatggctgggcacctgtgagaaatgaaagtgataggcagtaacttcagtgatgaattacagaacagtttcatttagctcattgcaccaagacaaagcatcccagcagcctctggagaaattaatgtaccttaacttgaattagtggataatttcagatcagctattttacatatctagctgcttctccttccctccataggccacctcttgccctttctcttcctaaatctggctctcaaagctaagtattctagaagttaaacattgaagtagaaatcagtggacatgattcatgtccttaccctctcagcagatgcctagccttgttccttttttacagagccttgttttcacaattgtcatgttagctcatggaggaagttgttacttcctcccatgatagttacatgaccatggagaaccctagaagtcagacagactttacaatccaaagaaaattactcctcggtggtaggattttaggtaccacaaaggcaactgtggacagagaaagcctctgactgcccctaaaaatcacatcatatctacaaataaataatgatgccattgcttgatcattaaattcctgtgggatgttggccgtgaaacttcatctttttgtatctctatttctcccttcctgatgatacttcctttccatttgccaatccacaactggcaaggagatcatcaaacgcagtgggcaaaggcagaatttctctctttctcatagtatttgctgtagttccacacatggtgactgaacacctggagcagaggccccgttgcacactgaattggcctcattatatcatgagcaagatcttctatcactgttactccttattgttgtgaagacttcttttatgtctggaaagacatttaggcaacttagcattgtgatagaaaacagctaaactactacagttttctaagttcaaatcaagatttcactcaccccctagcatcttactaaaacctgggtttcctataggggaggataaattgcccacaaagttatgactaccagaattgggactctgttctgtgaagtagaaataaatgcagagaccattttttcatcctagagtaagtagaaaaaaagcaacagttattttcactttcttttggcacacttggtttggcctaaaaccatcaactgtagaggtatattggtcttgaaaagaaaaaacaaccaa

SEQ ID NO: 200 - DNA, 44 bp, Homo sapiens
tatttctctgtcctgtaacactaagaataacaagacattacagc

SEQ ID NO: 201 - DNA, 23 bp, Homo sapiens
ctgaggcatgtggctaagaagaa

SEQ ID NO: 202 - DNA, 699 bp, Homo sapiens
tgaaatcttagcttggaaaccaccaatgaaaaacgttatatgccatacaatttggaatttgttctgaaggtgtgaaaagtttttttaaaaaggatgttaagccaaggaatgatgtattacatttgtttgaggtacctgataatcagattaaatcagattccagcgcaatgatcccccttgctgccacatgtggaaaaattcacagataaccttgatgggctcctccatatgggctcctaggaagaaagagtgagccagggttcatgatggggcagcaccaatttgctttcctgattttgtaacagggaaagcaaagtattaagcagtatggagtgatcattttgcactgtagcatacttcttaaagttcattcaggtaccagaggcattaccatgcattatgctaggagcactgccccatggccagtaaactgaaatgctatttccagactggtaaaaagtgagattagcaaatgtgtttacaacttgcaatcctagcccttcacccaggagctgtgttgaaacaacctgaatctaagggcataattaagaggacccagggatttatagtttgaggctttttgcctgagtactttccccaattcacccactactctgagcacagaaatccacaaatgtgctgtcctgaggtgtgagagggcaaaggtcacagcattagagcaaccagaatgttcaaaag

SEQ ID NO: 203 - DNA, 30 bp, Homo sapiens
tggaggagttggcttcaggtcaaaattgta

SEQ ID NO: 204 - DNA, 106 bp, Homo sapiens
gttgcctgaattgatcaccttgacacctcatagctctcaacatctactctatatattcataatgtacagttttcagttaaaaaataagacatgtagaaacacaaaa

SEQ ID NO: 205 - DNA, 209 bp, Homo sapiens
tttaaaagccaagtagtatggcttttagccactatattatatggtcttttaaagtataatatattcttaaagcttcgtgtttatcgtcccacttgaatttttttagtgcacaacgcatctactcccaaaaaggatttgagatatcttgataaaaggcatttcattagcaggatattacaatataaggagaaaacaatgtgctggtaggg

SEQ ID NO: 206 - DNA, 224 bp, Homo sapiens
atcttgaaggtggaagataagaagataggggaagccacaggtaacagagttttcacatcatccacttcaggtattctaaggtgcagtccatggccatgaggaccttgcgataggccatgaattggtccacttcactgttactcctaaaaccaggaaggtcttcaggccttttgccccaccccagtggaccatgaccacagtgttaagggccagatatctaactt

SEQ ID NO: 207 - DNA, 712 bp, Homo sapiens
tcctctgtccttggaaaaatgtttgaacttagtggctatcaaaaggatcttgccactggtggcacttagaagtgacatgctttctaagccaaaaactaaaaaggaggttctaaaagattgttttaattggaataagtcatgaaaaagtaaataatatggtcactaaaattatacagctcttctcgtggtttatatcataaaacagtcatgtgtcctggatgtttccagttttaaccgcatccaaaccactctggtttataatgaattggtggttcgagggttctagtatagatggaggacttactctttcattaaacttttaaatataagttcctgccacagtaaacacagaaatcatctgctctgtggtagcagctataggtgctctctgtgcacacttaaaggtgcatctccctgtaactgctctagccctggttggtcagaccatttgctgttgtttctcattcagtgtctgtacctcatttgactttgggctttgttggaccctcccaaggttttctgtccatgaactgacagctctcccattgaatttactatccagcaccttcttaggtgtcttgctataatctgacctttgcacacatgcagctttggttccagtggatggtgctccaaggcctccgggttttgtcacctggttcacatgtaaccagtagatggcgctgactttactgcttaaaaagtgggatgt

SEQ ID NO: 208 - DNA, 590 bp, Homo sapiens
gcagggtgtgatttttcacagcaggtcccttttgacttgatccgacgtcattgtcttaatctgcggcctgtgcttgtgtttggggttgctcttaaagtttctctgtgtctgagccaccatgcagataataaatactgcatcttgttactctcacaacaatttataaattgtgatggttcgcatctggctctgagtaatcattgatccagaagagcctagagaggtaaattcctgtaggccatcatgagcattgtgccagtcacatggtcactgtgccatgaaaaataatatcccgctttttaagtagtaatgtcagcaccatctactggttatatttgaaccaagtaacaaaacctagaggccttggagcacagtccactggaaccaaatctgcacgtatgcaaagatcagattacaaaaggacacctaagaagatgctggatagtaaattcaatgggcgagctgtcagtccgtggatggaaaaacttgccacttttcttctagggtgagtaaacacgtggtttctctgagagtgtatgacatttgcacattcctcatgcaatatcagaatgaagttcagtataccctct

SEQ ID NO: 209 - DNA, 240 bp, Homo sapiens
acttttacctgaggcagcatggccctggggttgacactatgcttgtacataatggaagttgttcctcgcttgcctctctcaatcccaagataatggctcaacatagaccacagatcaggaaggcacccataactttaaagtctctggaggatagggtggtgcagctagaagggggcccagagtcgaagatgaggccagtggctctgccagctgctcagctggcacctctgctttgaagac

SEQ ID NO: 210 - DNA, 1145 bp, Homo sapiens
cccgcctaccttaattctcttctcgtctctgtttgagatctttgtcagttacaccaccaattacagaaccttagtattttctatggttctggctacatgctggaattttgaaaagcaaggaaatcttggcatttttctcttgtttgcatacaaaatggcaaagggtacatgaggaaagtcattaaaattttgaaatattgatgctcattctaaaagtccctttggagaaattttagagctgtctttagaaaagcaggtactaaaattgttcatcaccactgatcatcactacccacctcctccccccaaaatgaatgcaatagaagtataactgaaaaccctgcctaaattgctcttactgcatattttggagatttctgatgaggacatgctgtgactttatgtagtaatagtagttaaaacaaaagcaatgtatatttcaaaattggacaagtgtctttgtagacctgtacagaactaaagcatgtagcctaacaggaggctgaagtcatgggttcccaggctggaaacaagcactggtggttgggagtttgactgctgaaaggtaagagggatcataagttgcccacacatggagccaggctcacagcctgaaacaggttggaatggggctcaaagatctgtgaacagagaatttaaagttatgtgtgccttcctgatctgtggtctatgttgagccactatcttgggattgagagaggcaagcgaggcacaatttctgctatgtacaggcatagtgtcaaccccagggctttacagcattagcagtttattatcatcaggcaaagaaacttattggaaaacagatcattcacagtagtagacaagctttgaagatttataaattgcctgtggaaagtaaggaaagaaaataaccacatgttcaattgcaattgatgtctactcagaaacctcatgtatacccccagggtaattccagctgcagacaggggtgcaaaacatatagacattaacaaaacacagagctgtcaattgagcactagaaatggaaaccattacctctaacagttgttgaaaaactgcagttagaatagttagaactgttgagagttggcaggagaataacaggagaatagaaacaattgaaaaatggtaatctcttg

SEQ ID NO: 211 - DNA, 388 bp, Homo sapiens
atcctgtgtctatgcatagaaggagaaagatatttgtgcccactgtgctaagtggaaaaatacagaaaattaattgaaattatgtctactctatttttatattttatcttttgcctcaatactctttcactctgaggttaagggaaaatgagaaaaagtgaccttcctaatgcttatacaaaatcaaacatttttcagccaacaattattttggagaggacttaactcttgcattaggctcaactacagctacactgtcatcacattcttagaagatttgatcacctgtcacccatgcctttggacaagtttgtgaaatgaagtaagcttggttattatttccaggcagacacaagaatagaaaacattttagaaaagagggtttttg

SEQ ID NO: 212 - DNA, 955 bp, Homo sapiens
aagaaagaaaaaagaaaagagggttttgatagtagttccaaatcccacaggatcttatagacctgacttgcttccaaaatgtattactaggctaagagtgatagaccagtagtcaaaatgaaagtcaacaatgctaaaacatgtataagtatacaaaaggaagagctctatagtagaatacagtaatttatttctagataccaccaaaggcttaaatgtttatttgaaattctagttttgacagttttatgagtttaaacatcttatgcaagagtacctgaggttgggggttggtgtgtacggaatgtacctgatatgtatatttactttttccaaaattatcattgttccccttactcatcctctcccaaggtacatagttttttccttctgcacattttaatgaaactcttctagcagcccggtcagaaatgacagtgtttattacagagaatggcaaacttgtcaaaatgatactacgatgagaaatcatcaccgtataaatcactgtcgatagcgcatggattcatttttgaaggtgacattgctgatgatatgaaatttctcaaggaacattgagacaaagagaataggaataatgcttagagtttgtccatcgtcctttagattctatgaataaaacacaggggttaatgagtttctgttggacttctgggcaaatatcatcagttcagtaacacttcttgtctattttgagcctaaagggaagtaagcatctgattacagagtggacatcaaccatcatatggagaggaaagactattccaaaggaaggttgattggctccctttttgctgcactatagttcgctttggttgagcatggcagtatcaacttgtgcttttctgaacaattgctcttcacaactttttataatatcttgaactcatctatagaagagtctgaaacacagtcagtactttatatatatgag

SEQ ID NO: 213 - DNA, 174 bp, Homo sapiens
cactgtgattccaggcagcacatagcacacagcactatctgtgtgtgctgagacttcaactgtgaactgccaaatgggaaaagccaggtccagaagacttatatttaggtaaatatgcttttatattcttgaaaggaatcacaagaaataattagaactgttatctttagaagg

SEQ ID NO: 214 - DNA, 87 bp, Homo sapiens
ttgcttattacgttactggaatctatctaagcagaaagaggctggcccaccttctgttatctatgtttctatactctttggacttgc

SEQ ID NO: 215 - DNA, 27 bp, Homo sapiens
tttttttaccactaatatttcagtata

SEQ ID NO: 216 - DNA, 323 bp, Homo sapiens
atggagtaaaaattcaaccagatatatcagagatatgatattatgggatttttaaaagtctctttttaatacattcattttttgaaaaagaaggaaaaagagaaagttaaaataagaaaaagaaggaaatattgtcttaaaaaataaaacaagctaaaagggagaaactttcctgatgagttagcgtgggcccttctcgtgatcctttagcatatgggaccaataggaagtagccattgagctatccagtcatccagggtgctgcagagaactgctgttgcttccctgagttaccacttggtcagagagaacttcccagcata

SEQ ID NO: 217 - DNA, 487 bp, Homo sapiens
catcatattctttttgcaaattatttcatcttgattatttcaaatagccagcagttatttcatctttccagaaagaggagagacttcccttcaatggctttttgatcctggtggaattcacaagaagagagcttcataagatcacagtgctttgcgggaagaaaaagatcaaagtggatgtgtaagatagccctacacagtgtcttgagaatacagcctgcacagcacagggatgatcctaaaaacactaagctatgccatcactagacacagttgacagggagagggttagtgtcaggtttcaccctggaggtgatcttcaccttgttctttggtcaaggtaaggtaagtcaagtgcattttagaataaaacaatgttttaaaaagtaggaagctccaaaccaaggatctgatttccaaggagttacagaaatgggattaaaatgacatttaatcaactataaatgacacataaaactttcttaac

SEQ ID NO: 218 - DNA, 2198 bp, Homo sapiens
tgagtatagatggtaaattaaataccagccaatcattcagcatttattttaaaatgatacattatcgaagcatttgtacgacattctcatcttctttgcagcactcaccttctattgcagtgagccaaagagtagaggatattccatctttagaaccatggagtttagaggggtttcagattttggggatacttggggtttgggatgacacatgaagaaattaatccatgaactgtaccctatagtattattcatatttgttgtttttctcttattagtaggtcccagtcagtacctctggagatgaaatcactcccaatcaaaaggcaacagtgacttcatattattattttcttgttctggacactagatgtcacactaagtaaagttttagaggttactctttagagtaaggtgtggcacagtgtctaaaatcttagctatgaaaaattatagctcatacataaatataaagctgaactttatatttattttttgtttctttttttttgtaaagctgaactttatatttctggtagaatgcagtaaaagggtactttccctaacaaaaaattcagaaaaagaattgttaataagaaaatgtagttggaacagcagcctattttgatgtctgttaaatagatagatcccatttacatgcacataaaatcgtatttccttctagtaacaaagtgatttttctagaggcagctcgtgtatacatatctgtgatcgtttatgttctgagatggcgagaagccattcttcctgcaaaaggaaccagacattatcctaacctgcaagggacggagaaggtgaaagaagagatactgaatatgagtttcattatctcctgaaacagtctcagggaaggatgtgtgatcatctttcttgagtggcttaagcaaagaagacagagaagatggtgcctcccagcctccttgacctcatttttttccttgattttggctctcagaaatctagacgagaatcataggttgagatttggaggcacattatttccttttggaaaatgcatatatatatatttaatggcagggaagttggactcagtatgtaaaagagtaagatattctatcctctaacttaaatgtgttattgaaacttcaataagtttccattgaaatgcttgaaattcattggacgctagagataattaattcaagccttaacagtcgcaatacacctttattttttcaagtaactcagtaattaatttgaactgtgtctaatgatctgcacatgactataaacacgtatttctatatgtgattacagttgtaaataatgtttacatttcagggttttctaggtagtgtataaggacaggtgatttccattggacataattccttctacatttgtcaaatatcagtgccttgttaatgctaagatcactaggataaataaggttacaactgctaaaatgctactctttaggtttgggagtcatccatgtgttcccctttcttattcaggaaatgggcaattggttattttaacagtgccttctaagactaggtggttctagttagctctcaaattctgttgggacttgggacgtttttcctcatattactgccttgtgttttagcaacctgaggtcacccaggtcccgagagaaatctttcattttctccgtgagtgctcgggggatggggagttctgtgatgatggcagcctgtgctgtttctccttcaagaagtcagacagccactttggaccatccgtaggctattcattccttcaacagtttgacaactcagaaaagctatagctcatcgtgaaggcctcaaagggaggaaaatctctccagaataaaatgtagacaagactatgtccgtatcaggtcaaaggttggggtttttccctgtgggtaggaaggtcagctctgtatttaccaaatagttattgaataaccgctctgcctggctcagggaacaagggtattatccctgcttagatggagtaaaacctgtgctcttcgcctgcctgactgctgttaaggttgatttatatcattattaagacaactgtcggggctgttgggtggccttcctggtttctccactgacttgccttttgatttttggatgtcagctccaggaccttcactctccatgcctaaaggaaggcctaatgctttaaagaaacattctgaggctcaggtgatttca

SEQ ID NO: 219 - DNA, 122 bp, Homo sapiens
agactgtgttgagcttagaattccaggttgatagctaggtggtgtgagaagcaaaagcaaacagtgaagcatccgggagcactttacctacgtgtatctcatttgcacgtcacaataactca

SEQ ID NO: 220 - DNA, 52 bp, Homo sapiens
catctcagggagcagggattcctctttctttcaatcaggatgtacttctaca

SEQ ID NO: 221 - DNA, 1104 bp, Homo sapiens
gatgtacttctgcaacttgaaacagctttgtaagatttggtggaggatttgcagaccgtggatttctaatgtatccatgaaccatatttttatttccaacaggtcatggattgacggcagtcaaggaaaaagcaggagccactctacggattcatggtgtaaattctggatcttctgaaggagcccaaccaaatactgaaaacggagtccctgaaagtgagtgatgtgtctcctctgggtgttcttggactttattacaccatgtgcataatcagaggttttccaagttcagatcagcgacgtgaactcttaaaggatttcttttttctctttagtaacagatgcagccacagatcagggccctgcagaaagcccacccacttccccttcatcagcctctcggggtatgctgtctgccatcaccaatgtggttcaaaacacagtgagtcgctggctgcttcctctctttcccctgtatttcccagggccttcttttgatatttccatttaccagtgacctagatacatcagagaaacgatggccttgctcagaactttggattatggttttttttttaatgttttctgctacaaagtagacgtaaccttggattcaaaataataagggcaaaatgaaatatattttatgtttaaaagaagggagctgtttggaaggaacatttttcagtctgatttaacagtgtcctttccagctgcggcaaggacagcctctggttgaggggagagagaactctttatcagagctgggacagctgtttttcctaaatgctctgcttatcttatccctgagtttgaaaaagcattaaaccgtttaaataaaaagtacccgttacaagacaggaaaaacagcccaaatatgtttctgaagtgtttccagagaccagcgttcttcccccatccctacctcttcattcccacccttcctcctccttacaccaccctaagtgtatccccctagatccctgcctacctcttagaagaagctccatattagcagcaaaacattggtgaataatgaaaaaaggggaggcacctcaactgagataaggcaggtagctggtcatcagggtcagggagcaaaga

SEQ ID NO: 222 - DNA, 56 bp, Homo sapiens
aggtgtatttcttactatgtaaactaactagtttttctaaaaatatggctcgtgtc

SEQ ID NO: 223 - DNA, 736 bp, Homo sapiens
gggcacaatatcccagaggactgaggcgactgaacaaataaacacaatgtaattcgggaagaggtgagggctgcggtcaaacatgagaggatctcacccagaccttggggtcaggacatgccagaaatatagaaaatgactggtcttctccttgctatttgaggacctctagactggggtgggggaagtaaggaggagcagcaaatctgtcttaggagtcaagtagcaatacaagtcaaccacccccgtggggggtttgtaggatgggagatggatggagctctgtcagtacctctggtataagaaatgaattcacggcctatctgagctaccaagagggcactatgagtttgtcttcagcagcctcacattcctttctgtgttctctccaaccttcttgacccctttttcccaagttccagacactacccctccaagtctatccttaacacaaatccctgtgtcctttcttccaccattttattctcaataaaataatttttcataggatgttagcaggcactaagtcaaattacacagaagtgtgaattgctgctgtcccatcatccccccgaagtgtgcgcactgaaaactgatttacagcatgattactggttggctcccaaatctaaaaacaaagtctaaatacccaagatgaaaataaagtatattaattctatgaaattaaatacttctatttaaatgataattatgaagattggaaaatgcatatcag

SEQ ID NO: 224 - DNA, 995 bp, Homo sapiens
ggtggggaaaaacacagatgtatgcatattataattgcagttatacagttggagtgtaagtatgaaagagttgcaaagacatgtatgcagttctgttcacttgaatagtttatgtgtgagtaagtctgggttattttaattttttaaaaaaagcaacaatgactgacaaagggatttgcaggaggatagctatataatacaccagtttctaaagccagaagtacaaggaaatcaacctgtctcatttcatggatatactaattataggcagttattgctagtttctgagagtatgcaagaaccatctgaaacagcctgagggtcttaccctccagggccctagattaaagaattccctaaattagcaggactgtttgacattttaatagactgctccaagcaactctgttacttgggttaaaaaaatttttaaacagaaacagcaatttattttatgttaattttatgtcttagcaatttattttatgttaattttatgtcttagatacacatccattcatacacagagagccagtaaaattaatccctttgtgggattaattttattttatgtgctttggtttttttctaagcatcagtctttaataacattgtatgtcctacaaattatataacatatgcttttccaaggaaacgagaataggattaaatggatgataaatctcctgatgagaaaaaattgtgactttatattgattttaatatttgaagatagtgccagttacctaggagttgctgactgctgcgaaacagcaaaacctaaacatctaatctcatgcagttatctcatctgcagggtaaaagtgtcttaactggaggccttgatgcgttggaattcatcggcaagaaaaccatgaatgtccttgcagaaagtgacccgggctttaagcggaccaagacgctcatggagagaactgtttccttgtctcaggttggattatatacgtttgcaattttttctttcagtcaataaa

SEQ ID NO: 225 - DNA, 165 bp, Homo sapiens
ctttttgaatagctcatttaaagcatgtgattcaaatcaaatgacaccaaagagcagagagagaaaactgagcttctaatacccccatttccccagtcacttaattcctcagaggagacaaccagttaacagttccttaaggattctatcagagaccgcagagag

SEQ ID NO: 226 - DNA, 523 bp, Homo sapiens
gtcttctcctctcacacttccagcactaaagttttccagcccttcttgcaaaacataaaacaaagaattcaatctgtctttgcttacttacaatagttaagaaaattggaaataatattagtcttgttttccaaatatgactctaatattaaacttacttttccagatggaacatgcctagcttaccccacaatccaggcatgccccagtccacctcctccacgagagactgatacaccaggtctctgtgctttcctgaaatcagaagcagctgatgcagcagtggattttgtaaacgtcacaggcaggacttggtactaggaacccatgaaggttgccttcatgaacagctatcactgagaatatgttcatggcaacccctagaagcttttgttttaggctatttcttcttgtctcttctggaataacccaagtatgagcactccgatgttatagtccagggagggactttgcaggatcatctagaccatcaccctgctgctccttgaaaaagaaaatagat

SEQ ID NO: 227 - DNA, 136 bp, Homo sapiens
gcatgaatattcctgctcacacaggagctcgtcccagggggctctcatggctagcacacttctgagcccacatcttctggcctcatcatcttgaaatgccttacttccagcctcacagagaggggatgtggaaggc

SEQ ID NO: 228 - DNA, 102 bp, Homo sapiens
tgaaggctggatttcgaagtccagcatttatgctcccaggagtaggagggaggtctgcaggttgcactgtcacaccctccactggaggcaattgcactttca

SEQ ID NO: 229 - DNA, 221 bp, Homo sapiens
aagcgcagggaatactctttaaataacacggggacagggggtccttggattccacacatggaagtctccatagcttctctgtgtcaggaattcttccaggccaggatcattccctgctattgaaacccacttccctttcttctctagtgggaaaatagaaccagcctccgttgtcaagctggttatccctcaggcagctttaatttcactccccagttgtg

SEQ ID NO: 230 - DNA, 713 bp, Homo sapiens
tactccccagttttgagtgagtccacatctttccagagtgaccctttccctttctcttcaatttcatcccttcttttttctctcccgaagcccacattcggaggtggaagctggtgtagagaaaggaagtgatttcagtgtcactttgttattttattttaccaccaccaagtcctgagatcagtgcgggtaattagtttttattgccagtgttaaaattttccagtgatggtttcattgggttgtttgaaaaactttaagattcagagtctgtgctaatttagtcttaaagacagacaggagagagaattctctttgcggccctgtgggttcttggcagataacctcgagaacccagaaggaaataaggctgattgtttttctggcacacaataaaaaccaaagtctattcttcagttgtcttcccctgtgaccttgtggtggtggccagtgtctttacagtgctttccacagaaattaaagaaccccatacacgtaatgcctcagtaaacttaatgaggaatcacataaaagatgcttagaatcaaaaacgcaagtgcagaaaattgagagtgactgatggacttgtgtttatttgttgtctttttgcttaaccaacaaaaaataactggagaaaagttattaatggggagaggaaacttggttcacagtcatatttctggaaaccagacttaagaatctataagctaatg

SEQ ID NO: 231 - DNA, 102 bp, Homo sapiens
ctaagttaatattcttaattgcagtaagtatatgatgacaaatacattatgagattatgtttattaatttttaaattgaggaaatttaataaccacgtacac

SEQ ID NO: 232 - DNA, 107 bp, Homo sapiens
ttataacttagaaaaaatcaggccagcttatttctgctttgacgtctgtgtaggtgcaggacttaaagttaatcctgtcataagagattcaacttttcaagcataca

SEQ ID NO: 233 - DNA, 1069 bp, Homo sapiens
cccaggcattgaatttttgctttgttttgcctttcacataatgaacatgtaaaatgtgaagtaggatatgatgtaaaagttatcaataggatcaatcaaaaaaatcattttttagaaattctaaagtgaccagaatctccccctctccaacacaaaatcagtcctcccaacctcccccatgtcttacacaggaaacggtgcttttaaatgtacatccagagtacaaacattgtgtatttctgcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggtacttctgcactactcgtttgaaatggcatgcttagtcatgtgttgcttaaacatgaaagaaactggaaaatctgccattaaaagatctcatttttagagcctcattattattgtgctgaggtcagaaatactgtacaatgggatgaccctcgagctccatatcatctcttctctgtcctatgctaagctattaccccaccccagctccaaaaaggcctgcacagtaagagccaccactatccccccacctcatggtgcaaaaggctgctcagaaatgtggctgtccagctgctggccctctgcctccctttggtaacgaagtacccaggtcagagatgccctgccagcccacatcttcattcctacccaatgcaaacaaagcacttgatgttccttttagacttcagggttttaatatattttgtcttatgggttatatagttatttattcagccatcttgttaggactcctgggccacaaagggcaggattatcttactgaaggttaaggttctattagggaatgctcccgtacacacacctgggaaacccagcctacccaatggccctgcacattcatactcctccacttggtcccaggaaaacaaaagatgaatagcaaaagtcagcagggtttggtgatttttttcccttaaagcatctatagtg

SEQ ID NO: 234 - DNA, 482 bp, Homo sapiens
ttatttagcaagcacttaatggcacttacatagccactattctaaataccataaaactgttaacttatttaactgtatatatgtggctgttttgtggatgtcaggctgactgtgctccggagtggttttctagtggaggccaccaggcagtaccctctgggcctccagagagggaggggccgtggtgacattcattgaggagaggcaggtccctagacaagaagctcaatttggcagtgagccttagaatggagaagtagtttttgactctccctagaccttatcctgttatgtttggactttgagccattcttgatgcctgtctaatcagagaaagacaacatctgccacataacaggcaaccaagaaccaaataggatggagacattgtcccctgccccagatgatggagctacatgttactctgtttatttccttctttgttatccatgagccttcagggaaagtcttgtggttaaaac

SEQ ID NO: 235 - DNA, 45 bp, Homo sapiens
ggcaaggtctggagtcagacattatttaattaaacaccatgcaga

SEQ ID NO: 236 - DNA, 389 bp, Homo sapiens
tgtacacatgttgatgacagttgatttttatatgcgttcttatgtcatagacatttgttgttattaaaaatatcacaggggagcgtggccctgctgtaaaaaaaacattacaagatatcatggtggtggagaatgattccattgtggtgacttccatcacagctctcagctgtgaaacagccccagggccctggaaaagagcccccaaggacttagtttctaggaagaaggttcggcctttggaggggaacagtttgcccattgcctccacaagctctgctttctttccctagcctggagatttttgtgatattcatagtaaggaaaataaatttttgtcttgacttagtaatgatagttaatgggtactataataaacagtcctacag

SEQ ID NO: 237 - DNA, 495 bp, Homo sapiens
tttttgagtaagcctgtttcattgcaagtcatcattgccagcttcaggtgtttgacccaaagaaggatatttgtattccgctttgagctacggctctacttaattaagtaatcttaagtagatgctcctgcctcagaaggcctccaagcctcttccttgtaaaaggagttgattggtctgtgtgattccttaggcctctccagctctacagcccatccccattcagccagaggacatggcgcttcttcgaggtctctgccaggacattagtaggcagtggaaatcttccaccaaaattcaagggggattttgaatatcagaagatggaaaatgagaatcaatccatcaaatttattatttgttattaattaagggtgaaagaaaagagtgaaagtactgaccaatatgcatctgtgatttcaattggccatgttgtcacagtcttctgtttctgtgtaaaattaagatttgcctttatgtcagctgctgggtatt

SEQ ID NO: 238 - DNA, 317 bp, Homo sapiens
caaaaaaaagaaaagctaacatttctactgactcttcctagctgatttgtgaaaacaaggtgatgggccaatttggagaaaaatatgggtagaagttggtgacctgacttcacttagccaagtcttttattcactgaccatattgccatcatcttacctgtgttccagaactggttaattgttacagtatagtcccagggttttgaaggaaaaaagtgggaaacttgctgcaaaggcagccagatctgtccccactctccagctccctgcggtattttaagtcagcatctcagaggaggatgatggtcaccatccta

SEQ ID NO: 239 - DNA, 199 bp, Homo sapiens
tgttgtcaggcataaaataatgattctgtcttatttctgaatatttaacttatacgtaatttcactctcacgttttcacttccttacagaatatctgcttctttcaagaagtattttaaagatcaatgctgtcatattcatttattttactatagatcaaattctatggtaacaaataagattaccagaaatccccagg

SEQ ID NO: 240 - DNA, 345 bp, Homo sapiens
ctttttctttcaaaatgctctatccaatagcccagaaatacatccaatttaaaagaaaaataaatgcattcaatttaaaatcccaaatgaacttgctcaattttgtggggaggggggttgtgttgaaatttaatttctgtgctatttgggattcatgctacttctcagaagagacacagttttccagtagagataaacgacctcttccaagaacaatggaaatgaaagggggatgggggtggggtggggagtgctgtgggtagaggggcaggaagcacagatgaattgaaaagagaagagttataagcaggttggcttcctttaaaaagatgggatagggtctcc

SEQ ID NO: 241 - DNA, 126 bp, Homo sapiens
gttaggctatctattggactatccttcaaagagcggctgtgacttagtgtgaaagcagatttttaaaaaatatgaatacagtgagtcacaaaattctctcaccaaaaccaagatatgaaaaaaaaa

SEQ ID NO: 242 - DNA, 152 bp, Homo sapiens
ccatttaaccattcagtctattctactgggtatcatctggtggggtataagaagtctctttagataaataatgttttcagagcatgcctttttctttcctttcccaggatggtgcataccatgggggatgagggggtctcttccctcatact

SEQ ID NO: 243 - DNA, 324 bp, Homo sapiens
aggggcatgagggctccttcggttgtgagtaacaggaaatatggccttggactcatccattcattgccttccatcacctccacatcattattcttcaatggtgttaaacatgtcctcaaactaaagcctacaacctccttgcatgagtcctggagaaattctcatccactgtctcatcccagtatcttttatctcccccagagagtggatgtttcagaagcatcccagcctcgtcttgagttttcttccctgagctgctgtctctgacctactttctttaccaccatctccccttctctccccgtcttggctcataagtgaatg

SEQ ID NO: 244 - DNA, 25 bp, Homo sapiens
atggcagaaatttgaggaaaatcag

SEQ ID NO: 245 - DNA, 121 bp, Homo sapiens
gacgaatatgttcttattacaaatactcaacaacacaaacatatatagtaaaaagaaaaattctgtcttgccttacaccccatcctaccatcataataccccatcctaccatcatactttc

SEQ ID NO: 246 - DNA, 233 bp, Homo sapiens
gtagttcaagcattgcagatatgtttgcttcataagaacctaatgtggaaagtgatggcattccatatctgtcttttgaccacctgtaaacatgaaaaacaatgctgtcaggagcgccgttgccagaagctgagcttctgctttaattttggtcattattcttcatttttaccacttaatcagctcccctgaaatggcagagttttcaacttaaatttttcttctttaaaaac

SEQ ID NO: 247 - DNA, 453 bp, Homo sapiens
atcaacttatatttttctcaatcaaaaagtaccacagtatagatagaataaggcaaattccatgtgttaatcagtatggacctgtttttagtatcattattgcagagaataaagttgaaacttccagtgcatcatcctcaaaactgcagagtggtcttttagtgggtggcagagtcatggcagtgggttctctcagtggtggtcatgcaggacagcagcatgcccaagttacccccattgtgatgaagacatgaaatgcttgcttccctgcactgtacagggcctcagtggagaacaagcttgtggctgcaggcacagcacagctcaggtgccagttgtcttgacacgggtttgtcgctacccagtttagtgaattcactactggggagacttcatgccctcctttctgcttccattgcctttaccacctccggctaaactatattctttctc

SEQ ID NO: 248 - DNA, 760 bp, Homo sapiens
caagaccgtgagataaggcttgaaacctaaggaatttcaaagagggggccatgatgggcattcagcggcatctcaggagggggcagagtaaccagcaggtgctttgcatgctggtctggtgtgtctggaaaaggcatcccgctaaaacgtttgtcaggaaacttctcatcagcatttccagcatgcaggagcaaccaagagagccacttagataccatttgattataatgtgtttctcagagaaataaatagcccaaatggaagcacacttctgattgtcaattttttacaaacaccctggaactcaatgacagttctcgaggatcgatatggtctggtgacagtgaattgattgttccagcagagatctttaatgagattgttcacactattcaggcaccaccatctccagcagattacaatgacaatggcggggccttgtgaatatagaaagcaaagcagccttcctgctcatttctttttgaaagcactaacccctagcagcaaggccttcttgttaattagttgttaattattgggacaactcgtgaaatgtttattaaagagctggtccagtggcaaagaaaagaacccagggcaagagacagaattgaagggtaataaaaggaacgaatacgcttttacacagttcactggcaccaaggaaattctagcaactcactcttctggtgcaagaggagaggtactgtagaaatgcatagcaaacaaactagaatggatgaaaatgtaacagacacat

SEQ ID NO: 249 - DNA, 132 bp, Homo sapiens
atgacatgtatggtctatgatgtatatagtcaaagtaacacacttacaggctatgatcaaagcagtaagcccacagatttagattgtctttcatgtaacttttaacctatatcccatgactgtataaccaga

SEQ ID NO: 250 - DNA, 874 bp, Homo sapiens
aaaatttttttatcttctcttcattttaaaaaaaatattctaaaatctacaaaaatagaagcagtccaggcttctcgaaactctcggggctcttgttccctgctctatatgctctcattgtagcatgtcactttcataagtgatttaagttggcacaatcaggttgtagctttgatgatgttacattaacattatcttacaacttttggcttttataaaggatgactattttttttaaagtaggagattctgtgttgcatatctgtaaagctgtcataggaacccagaactttgctacccatctcctgggaggtgtagacaacctggacaccagtcctggtaaattcttagggaagagcagttagtattttcgttctctatactagccacgccgatttatttgggtggctctgaaatacgccttcaagttcattcctatgcacaatcatcttttaacttaatatagttacttaatatagttgacttagtacagtaaacttaatacagttaatttaatatagtttacctgcaatatagcaggtaaaaaaatcagagtaggggtaaagtaagaatattattaaaagcatttttattctcccttgaagagttgctgtaaaatgttatcttttcattcctgctttctgctttcagaagtgatttggaaagtattgctggatgatgccacttttatactgaaactatgtaggttctatgcaatctatgataattgaagaaaaagatagattctattccttaggaaacccttcagtcccttacactggccctgttacgtgacgccaggcatgcagtcttacctgatgcagctagtacttctctctgtctcattcctctcccaagtcacactgtgtagtct

SEQ ID NO: 251 - DNA, 1311 bp, Homo sapiens
acactgcattttagtgttaggcattttagaagcacccttgagaaactctgatctgcccgcattttcttaccagtcccttgacatggatgcatgtttttgcatccatccaagggacctggtaagaagcctctgaattacagtctttatctgtttatttgggtgactcactcctgggatccctggggagatgccccctcctcactcagcctgtctcccaggacctgcctccactccccttgcctctggcagggagaagaaaaggagcctggagaagggcagacccccagcaggataatgcctaccagtgggaccttccttctaggctcactgcattgcctatgattatttttttagaatagatttagaaaaaacccaggccagttggggccagttctggtgattctggtttatgatcaagtgggagaattactgttcaggatcaagctacatataactataacacacatcacagctggcattctggcttgggtcataaatgcatccgtggcattagatgcagcgtttcaaaaatactctctgcagtgatggtagatatcacagccaggctgccctgaatgaactcacaggttgcttacaacttgctcttgttccaaccagtcgggcagccatttttattggctgagtgtctcattgattcattggtactctgctatgccagttgttaaatacttgtactactggaattaatatataatttttctcctgaaggacgaaactcctgtgaatatctcaattcagaatgtttcttaaaaatctaatcttgtgaactaatagtcaatctttgcaaatgatgtaagtcatatgactcacattctaagtgaaaatctactttaagccaggttaatattggtcctacatttattccaggtattagcttatataagcatgaaatctccatgctgttttttctactgttgcaagcattcacttccaaagtatgcataaggttggaaatttaatactcccaatactccagcaaaaagatgcctttaactttcttggccatatctttagcttggtttcctacagatggtactctgctgattcatttcctgatggtgcactcaagttgattgttttattctttcgaagaatgttataaattgcagtttgcttagagttgaatgatgatggggtgggctggggtttacagttgagaagcaccactttagcttataataagacgcatataatttcaattcacgaaataggctggggaagtatttataaataattatatgtctggatgtgtttgtatatatagttacatttatttttaagcatacatag

SEQ ID NO: 252 - DNA, 77 bp, Homo sapiens
cacacatatagtaatgcaaaaaaccactataccattaaaaaatttttaacttaagttccaattctggggatacaagg

SEQ ID NO: 253 - DNA, 62 bp, Homo sapiens
ttaaaaagtaacagtgtatcatgataaaaatacataggcacatgaatgaaatataaatacaa

SEQ ID NO: 254 - DNA, 341 bp, Homo sapiens
gccatctttgaaaacaatctactacaagtagaatttgccccattctcaccttttaattagtagattatcacgtcatcataatcatcattttgtgctaagacaaattatgaaattaaaaccaaatcactttaaagaaatacttagcattttgaggaacacatttatggtgaacatatcacttttttccggctttggcttaaagcaagttacatagttgggattctattggattctttcttgctccctggttccaaaagacaccatagtaatactccatactcttatagctttaggctacttgctgtaagagataaaaaactgttttcccactttcaaatcac

SEQ ID NO: 255 - DNA, 285 bp, Homo sapiens
tttcacatttgcctttaattagaattctgtattgcagaaattcacacacatacatatgctcactatgctgatatatgtagagtccaatgagaataacaataatttcagaaatgtctgattgccaaaatcagatactatttttcttagacttcaaaaatagcgttgccatgataatctctcttttcaaagcatagctctcatgcattttgcaaagttattggtgatccttaaacaatcattaagtaagtgactgaatctaatgctaggtaaatatttgttgtttag

SEQ ID NO: 256 - DNA, 89 bp, Homo sapiens
atttttccatggactctagcaccaggcctgtctcagtggactctaataccaggtcagctcctgcaacccctggctctaggctcaccctg

SEQ ID NO: 257 - DNA, 45 bp, Homo sapiens
atcagctgctttatttatttatttaaacctttgttttacattcag

SEQ ID NO: 258 - DNA, 257 bp, Homo sapiens
aacccatcccccaaaatttgtggtttagagttagtatgaataatgccaatgggttttcagttcataaaagagtgatctgctgacaaaagaatgaggggagcaagttttaggagatgtgttgactgaggaagtttcttcagaaggagctgctgtatattccattatgttttttattctctgtttgatcttgctgtcctgtggaactttgatgtaattaggaaacacattcctcaggttaaatgtgaataggatgggat

SEQ ID NO: 259 - DNA, 84 bp, Homo sapiens
aatgtactagtatgagggacatcattacatttaaggagcctgggaacacggttctcaggctttcggtttggttgttctgcacaa

SEQ ID NO: 260 - DNA, 227 bp, Homo sapiens
tcttctgcacaattttttaagtggggggactcttttgaaaggacttcaggctgagacttctgaaagcatgtagtgaagggctgagggacaagaccagaaggtggggcctagccaaggctttgtactcgcattcttacactctcctgccattgtccctgtgatgaaatgagcttcatacatatagtttgcttgaaaatacacctcatgggccaggtgcagtggctcat

SEQ ID NO: 261 - DNA, 830 bp, Homo sapiens
caccccatgaagtgtcctatgatcaaatttctgagacagaggagagatatggcatgctccattgtgattaaaaaaaacgtggcttgtaaccttggcttctccatctgtcaagtgatgacaatcaatgcagcaataactgcacacctctctcacttcctctctcttgatcaaggaagactgtgagaattaagagttgatcagaaagcaaagtaacaatgatatgttacagaggagtgagcttgcaatgagatctgtgaaatttggcaaagcacaggaagtgtccaattcagctagattggattggtgctaaggcagtttgagcttgaggttgtccagaatcctttctgctaacgaatgccaactacaaggggaatccctgcctcaccgtttgcatatagatttaggaggaaatgcagatttgctcatttggtttctgtgcaattttagagtcaaaatgaaactagaatgtgaatattagagtatgtgaaccttcttagtataaagctggattcccctctgacttctgtagcatttaggaaattgtgccttataatagcagcaatcaataatacattgtcctttcatcaagtaacaacaatgactgctgatgctcagatcctagtgttctgtagaatctagcaacccattgtttggatacaagggtgcatgaattaacaatattcactgctcattttctttgtgtttgcattctagtcttctggaaatggatttactaaaaaaatactttccaaaaaatgaagtgttgattttttttctttgtcaggtaagagccataatacatgttcatcatttttaaaaaattggaatag

SEQ ID NO: 262 - DNA, 51 bp, Homo sapiens
gatgagaaggaagactatgcaacccaaacacaatcattgttgacttgtata

SEQ ID NO: 263 - DNA, 95 bp, Homo sapiens
tttataaagtttgcagtgaaaaaaatatgtaattaggaattatgtaaatggatgaaaatatagcaaagaacattctccccaccatcaccaaatgc

SEQ ID NO: 264 - DNA, 83 bp, Homo sapiens
agactgaattgttaggtatgaaatacaaaatgagcgaagatgctcccaaaaacaaaataacgaaacaaaaataaaaacccaac

SEQ ID NO: 265 - DNA, 94 bp, Homo sapiens
tgattctacagcaatcttttaaatttttgagtaaaaactcaattgatatatgtttgtatctttaaaaacaaattattttggaaatcctgaagcc

SEQ ID NO: 266 - DNA, 35 bp, Homo sapiens
gacaaggacttcttttaaaaagcatagccatagcc

SEQ ID NO: 267 - DNA, 283 bp, Homo sapiens
tctaaacgtgtccgatgagggtttttttcctgagtaattttaaacctgtaacttcacaaatattgatgtgcttcagtctactgcagttattgatgcttgaactgtattatctttacctgggtaaacagaacttcctccatttagttattgggtacttgtaacactaccccatcatattctaggctcaacctgttctatgtaatatttttaatgatatctctccatattatcttttgttctatttttcaactagctgacaaacagctaggaggcgtggctgttg

SEQ ID NO: 268 - DNA, 183 bp, Homo sapiens
aaatagtagttattttcattaggtttaataagactgctttagtgtgtcctctttctaaatttttctaagcattattgacacagttgtgattataatttacatttatttgcttcctgacattttttcttgtaacaacatacacattatatatgttccaacaaacatttcagaaacacaaattcc

SEQ ID NO: 269 - DNA, 278 bp, Homo sapiens
tttgaccaaatttatttccccatggtttgtaatcgattcacatttacgtttttagtgtggactgaaaaatgtttatccactgccaattatttttcatgctcttttatacaatccgatgacaaaatcaagccattgaaattggtcagcgctattgaaaaaatggtgtagtatggtcacagtctcctagcagtctatgtacagcaatgtcagcctagcttcgttgagtcaaaccagggagatggagggaaattttggctgccacagccttgagtgcggtg

SEQ ID NO: 270 - DNA, 183 bp, Homo sapiens
ccagcactctgagtaatctagtaattgggttctgccctctcatgagctgacaggagaccacaatcacgtgaaacaaccaccaaagatggtaacagctcagcaagagtgacttgggcttaacaggtgcagagtcctggcttggaaagggagcttggcttaccagggctctgctgcactcttgaa

SEQ ID NO: 271 - DNA, 30 bp, Homo sapiens
tcctcccagaaagagcagatttttgccact

SEQ ID NO: 272 - DNA, 288 bp, Homo sapiens
cataggttcctgacattcctttgagtgagaagccttgatctgacaggaagacagctagagagtgcttaactgttgcttctccagagtcaattccttgtggaaactttctgtccctgcacctgtgaaatgtgcttaatggattttggagacctacggtaagatggaagatgatagtcctcaaaggccaggaatcccaaggtgtattacttgagccactcctaaacccaacaaaatttcccttctaaattgctatccgctcccaaataagtatcttaatttagctaattt

SEQ ID NO: 273 - DNA, 219 bp, Homo sapiens
gtgcatttgagccacctttgcctcctaccccttgttttgggtagggagtgggtttcttcctcttgtgatgggaatatttccatttacctgtgttatacagtcttggttctggggtttgcatgctgagtgtagcaggaagggaggaggaagcacttacttctaaagggcacagaatagttgccaccttcgttagctattccttttctatttcctattcac

SEQ ID NO: 274 - DNA, 579 bp, Homo sapiens
gagagaaagagcaggcaggaagaaaaaccagcatccagctgtgccacagatgtgcttccacctctgtcttgccctctcaccctcgcctttaatcccattttataaaaactcatactcagaggttagctgggttggaccccagtctgaccaacccacagcccaggctggccacaatgtgtgtgtgtgcttagcaggggggcagtttttggggactgcaaaaggagggtctataaagaaggacctcatctctcaccccctaggggcagcctctatgggggaggacgatggtccctgacatcatgggacagtcacgaatgagggtctgtcctgggtcaggctggtgggcaagttgatctggcctctccacaaggctggctcttgcctcccccattagtcagtagcactgctgctcgtggctctttttagtttctgccttatgaccatatttgacacactgcctccaacctaaggtccctatttattcttgggcacacgccttggtgacatgctaccactgccctccctgcccagaattgtgtttggcaagctgtggagaagcttccagaatccaaaagaccc

SEQ ID NO: 275 - DNA, 1067 bp, Homo sapiens
tgaatggagacaattagtttaaagcaggcacgcgtaaaaccggaggcagcacttaaataaggcacaaacatgcctttaaatgttgttttaaagtcaacctttactttcatcctcaacgacttaattgacagaaacaacaagtgtatctgccaatatgtgggccggctcagtgacccatccactgagaagtagaaagcatatcatgttttgagttacagtttattgagcattaagctttcttcctgttttttctcacttttcagagtgatatccacagatattttcctataactgtgtgtaacatgactgtgcccaacgttagactggtggaatggtagataaagggggcaagaattcacaaaagggaagtcctgggaaaggaaattgagagtttataaatatatgaatgccagctcatttttattttttaaatactctgtacaacacaccaacataaaatcataggatatagtggtgattgcattcttatgcatatatctttgggtattaattttacgaaagatataaagatgattttgatgcagatggattccacatgttactgagaacatgaaaaggaggatcagacggaagcaagagaaaaattccaccttaggctctttcttgaaaggtgcagtttctccaccattgacatctccttagacctcacagtgaactggcaagtaggtccagggaagagatttctatagtatcttggctttgagtaaaagaaaatggacccaaaagcctcatcttcacaagacaaccttttggaaatagatagaaggcttgataccaaatgtgcttgaggtgtagctccaaagcagcaaataaaggcgctgccacacctgtgcaggtgccacacccgtgcaggtaccatccagtgggggcctggggcatcgcatgtcccagagcacccaggcacagggaggctgctcagcagtaggatgtgtggcttttgaggactcaaagacacttagggggtctctgcttctgcatttccaagaggacagatagctggggcaggtgcaccaccccactgagacaccagggcatgaagagtggca

SEQ ID NO: 276 - DNA, 485 bp, Homo sapiens
tagcacataggtggactgaaatccgctgtcccccatgagtgtgtaccgacaggtatgccctccaccagctgagcacaccagcacccacctcccctccctgacctgctcgcagccagcccacgcccaagccctgctgacattcatctcctttatctcttagcctgacaactcccctccttccccaccacactccactcaaagcaacgtcatctatcacctgaacctcctcactgactgctctgcctccactcctgcctccctcccaccggcatctgtccccaagctgcatccagactccagggaacacaaactcagccgcggcacccccttcgctgcctcctcctcgtgtcttctgttgccctcgtggtagggactgacatcctgatatggcccatgaggccccctggagtctgcccccacccagcggcttcctcaccatcacaacggattcccctctctgagcttctcctaggtggccatccgcc

SEQ ID NO: 277 - DNA, 88 bp, Homo sapiens
gcttttacaaatcatggtaaccatggtacttagtttagttgttgacatgtagccagcactttcttattcatttgctagttatggttaa

SEQ ID NO: 278 - DNA, 64 bp, Homo sapiens
gtggcttggatagggcagagccatggacaaggggaagatggaaggagatctgtcccagaggcat

SEQ ID NO: 279 - DNA, 199 bp, Homo sapiens
aattctggcttccatagcagggtggatggtggctcatttactgaggtggagaagactattgaagaatgcatgggttgatggatgaataaacaaacaagcaaatatgtagagataaatagtacaataaaggagactgggccttcagggtgagatatattcataaggcaaaaaagcttccatatcggtcagggttctgctg

SEQ ID NO: 280 - DNA, 52 bp, Homo sapiens
actctaaatgattgttccgtggaaaccactaggctttaccaataatataact

SEQ ID NO: 281 - DNA, 539 bp, Homo sapiens
gtgtcacttcattttgtggaattactcaggcaaagtgactgctgctaggcaatagtcaaagtcaaaatggttaatgggtctgaaaccagtggagatctgggaaaattttaaaagaatagtcaaacatgacaagaggtatcactggggaaaagaaacccaaaacattagcatttggcttccaagcagctcacattctggccttagacaactgttacctcactgctcagaaatggaagcttgaagctcgtgtggaaaaccgacctcctaataaatctcacacagaggatgcagcaatttgttatgcgtgagaaaatggcactgggaaagcaaaacacagccagcttgcttcatatcacaagtagcaattgggctcaggttttcacctaatttttaagcagcttatcaccacctccgaaaagaaaaaaaaaattctaaaaattgcattgcttttttttttctgagaagagcatattatgaagtgtaaacattaagaaagtcatttcccaatataactatttccaagctttgtctaccacttg

SEQ ID NO: 282 - DNA, 502 bp, Homo sapiens
actcactacctttaaatatttttgtccaatcaatacagctccctctcccttttttggggaataaaaccttgctgaaatgaacggactctaatatcttgatttattaacccacatctgagccaaaatgatgtttgtttgagaatctacttagtactgactgaaagaaactgtacaagaggtttttttgccaatgtgtgagaaaatagatcagagataagattaatctttacaaaagacaaaaagcttacaatgctttgccaaataaaattaactttcataatttgcctactatgtatttactatgctatgctatctgtttagcatacaaaccccctacaatccctacagtaatcctagatggtgcctacgttttaatctcaggtttatagatgagaaactaagacaacctggacttaaagccaggccaccttactccacaggccacaccccccaccacggtgaacactacagctgtgataagacaacagaaaattgcttatcc

SEQ ID NO: 283 - DNA, 43 bp, Homo sapiens
ttgactcacctgaatagtgttcatttttatttagaaatgtaac

SEQ ID NO: 284 - DNA, 1064 bp, Homo sapiens
ttctaacatcttgatttactaacctacatctgagccaaaataatgcttgtttgagaatctactttaagtaacaactgaaaaaaatttatgagttttttattgccaatgcgtgagagaatatatcacatactgacaagataaaataagattaatatttacaaaaggcaaaaagctcacgatgctttgtcaaataaaattgataatttccctaccatgtatttactatgctatgctgtgtatcaaacaaaaccccctacaatccctacagtaatcctagatggtgccttcattttaacctcaggtttatagaagagaaactaagacaacctggacttaaagccaggccaccttactccacaggccacaccccccaccatggtgaaaactacagttgcgatgttaagataacagaaaactgctattcataatagtaaattatatacttacatccctcgactcatctgaatagtgttcatgtttatttaggaatgtaactttttaaagaatgcaaagttttatttaagaacctgcaaagttacctcatataacagcaatattcctgccattatgctgcatatggagatagaaacctataacaatcatctttccctctaacttgcttccaccttctccagtgggtgacagaaaagacagataggacctgtacatccagctttctctgctaccccttgaaaaagctccatctattccaatcagtgggcatgcagcttcctggttttcttacacttgctgttactcatagagtatctcgtgctgttgtttgcatttttactagtttcagcttattttagggtttcacttaacgcacagctttgtacggaaagtcatagattccactgctcctctcagtgttttacacaggttttactgaaacccaaacccctgcctagcatccctctttttcttcctcacttcccatggcaaagtcagaatttattcttgagatttcaatcttctcagccttttagctttcctggctgtgggaccgcagaaagctagcactgcagctatggtctagcaggacagcgtcccagccttattcc

SEQ ID NO: 285 - DNA, 582 bp, Homo sapiens
gcatgctgtataacataccccatctcccctctctataaggacatttcttttagactatctcttatttcagtcctgagctccaccttgtcaagtattctggatacccatgagggcttagcaaaagggcctatgtctgtcaccctggatgggaactagccacttcaggaaagctctgtgatagccatgtgtaaggtcatagttagaaatgcccccaccctttctcattaagttctccctacccttattcacatttggcactttatttaactcttcccattcatatattttgagacttaggctgaatttagcaactttacatcttctaccctttctcattgtgctaaagtctccatcagggtcatgcaaatggggaaataaaggttgagcaaatggggaaatattattctccatatggattgtgaaagtgtgcaacctataccactgtcagcagcagctctggtcttcatcctgccccattgttttctgaaggtgcacaatccagcctcctactagaagaacccagactcttgtttccccattcacaatgggggtgttcacttacacattaggtcaacatagttg

SEQ ID NO: 286 - DNA, 1483 bp, Homo sapiens
ccaccgactctctgtcttccccttctgcaggtccagcctccagggcgatgacaagggtgagagagaaatatgagcccagcctgccaggtcaggaacaaggagagcgaggagctgcctttccttttccctggctccttccaagtggcagtgtggacaaacagaacaggcaagatgctgtggatgtggagctgaatgattcatcatgcacatcaatttaaccagagtcagttagcagtatcccaaagctctgaaggacaggggctcaattaaccttttaatacacaagtcaaatttcttgtcttcatgacttacttctttaccagcaaaaagcctccaaaacccttctcagatctttgtccaaggtgaggctaaactctgtcactggtggggcttcctctaattccctgtgttgttctgtctgctgtgatgttatcactctaagagggagggtgcattttgaggatgacagagaaggacacgtatgatgcagtgttaacgcagacctttctctccacctggatgaagaactacgttctctggccgccctcatacttgtcgttaaaagaacgtaaattatttcacaattctctcccctcaaacacacccactatttctctttcttcctgcaagagctgagtttttttctcttcaggataaactagcacattcttttaattcccaggaaattatacttttccagggatgattaccacccattctcagagtttataagtccaagggtaaggccctgatccaattggggctggagctacagatgagaatgaaaatgacagaccatctctgtgtgctcctggactgtgagaggtaaaatttggaatctgacagctgtcacgtttcctgataaatgaaccagagaagtggagggagaagggaggcctgggaaaaaggcgctcctcctaggcttcaagtcctgaagccaaagcacattctttactttgagtcccaaaaggcaactcattattattccaataacaccacctttgtttagtctgataggggtacggtttctgtcactagccaacctagcgatgattattacattatttaaattaaacacccatttctatttttgggaggccctcgtgggtgatcaacctgctgatttatgaaccaattcatgctacggtagtgatggggaatagcagttaccacactatcttttgttataccaactttgccttgacacccaatgtttaatgtcttgacctaaagtaatgactaataaaccccaatgccagcaaagaggaagcccacagagaaccagcatcagtgcagatgagtctcaaggcaacacccaaatatcccactaggcctctctcttcctgcatacacatatgttaaggcttgaatttaatttttttctcacactataaagctaagctgtgtcagtaatccccatgccaacctgctggagaaaaagtcaatctaacatcattacatttttctggctattttaattcag

SEQ ID NO: 287 - DNA, 796 bp, Homo sapiens
ccacattttccctagtacctgcctatttctagaaaaagctaactggaaatcagaaacaaagaagacagcctttaactgctttattaatgggagcttggtcatgtcatttccaagttcttctttttccaaaagacccaactgatagtcccgtattcataaggcacctgctccctcacccctacaagttcaaatccagttttctttcccttttggagcttttcctggtgaaattatagcttctcatagtgaaggtgaacagcgtgctggcttatctggtccctccgtcaccttccccacccctcatctgccctctgcaggtcagggtgtcaacagtctccaggacaggtgttaactaacctacccctggaggcactatgtgttgggcagtgagaaacccaaactacattccagactcactcatttgaaaatggaattaataaaactgggaattaatgaataacaatattttagaaggagtcacaattgcaagatgccctgctaacccagcatccaaaaaactgctgtttactctgtcatctttggcaatacacaccattattacatcttagttgcttaatccgtaagaggcaggtaagatgccaagcaattccttggagttatggtaagttattcatgcaaacactatatttattaagtgattcaagcataaaggtcattcaacgcttacgctctctttctaatgcccttctgatgctccttcttttaaagcctggtggcaaaagcactcccaactcagaacacaggagtacaacttgaattcagagaatttaagatg

SEQ ID NO: 288 - DNA, 233 bp, Homo sapiens
caactgaattagtcctcccagaattcaaggtctttttaaagcaggatttaattcatatctcagtagctttccccaaaattttcagcaattgcaccctgcccacctattcatgaagctgagagggatcacaggagttgtctagtcccaagtccccagagatgttttctggtgatagactgtaaccaaaacgacctctggtatttattaagtttgcaaaatcttgtgtcaaagtt

SEQ ID NO: 289 - DNA, 37 bp, Homo sapiens
atcctaggactgatttgtaggcgaataaaaatgctga

SEQ ID NO: 290 - DNA, 693 bp, Homo sapiens
atggatcagttttcaatgaaatgaataaaaggcaccatggtgtagttctctcttcactcacgcacttccctcagaatttcaaagccaacgagttaacaaaaagacaaatttacactggaaatcaacaaccatctaagctgtggaattttttagtgcattgtgatgtccattaaaatctgtcacccaattgccttccaaaaccccagagcaactgaaacacacaagcgtttttgagtgggcaggggttaaggggcagaagccaagagaggatcagagacatctcccagtaacacaggggcccatttccctgaacctgtcaaaacctttgagcaggtaacaccgaggagtgggtctcctgtggctggctttgcaactccttctcttccgattatgaaaatatccttcttacactgcaccgtaatcatttgaatttttattgttttcactcaaaagctcctaagttatttagataagcaccattaaacaaaaatctgagtaattagttcttttgatgtgtcctagtggcagtggaggaacttgaagacgtttattaactgttagatcagtcccaggtgggacttattataaacagagcttagccccagagcagccgctcattaaatactgaacaggaattaggtatttctctcttcccatgccattcttcatcaaccagcctctaccacttgggta

SEQ ID NO: 291 - DNA, 102 bp, Homo sapiens
gccactaaataccacaaatcattgcttacgtgaagtcccggaggtggggctagaacacaatcacaccctcctttagagactgcgacccagagagaacaatca

SEQ ID NO: 292 - DNA, 422 bp, Homo sapiens
gacccgcttctcccatctcttgctttagtaaattttccatgccaagacattttcaagtgcttgacagtcacccacggatgctgactgctctgagtgatctatggcaaaccacccactcttttcccagaatgataaatgtttcttatgtctaatgttgatataaaatgttatgaaaacgagaaaatttgggggatcttagaaaataaaagaaagatttacatgaaataaaaatgagtggttttatctcgtgtatgttggaaaacagaatagaagttgattggcatccatggcagaaggggatctgggttctcacttgttcccacctgttcaagcatcccagtggagtcctcagtcctcaagtctgtaaaccaggctgaacagccccaggtgaccgggacacagtgggaagtgagtcaactaac

SEQ ID NO: 293 - DNA, 1258 bp, Homo sapiens
ggagcatagccctcctgatacaccactctggcacatagtaaatgccaaataatcattgtatgaactgatgaatgcacgaccaacccccatttcacagtgtattttaacaaagaaacatacacagagccttgctgcctttgtggaatcaccaagggaaaatagctcagccaaaggtactctacatagttataattctaattctgactaacttgttagggttctccctctggtgatatattgtagaatttaaaacatgtttgcaataatgcatgccttcatcttccctttaaaaactgtgtgtgtgtgcatgtccacgtcattgtgtcagagaatgggtttgccaaataggcctttgtagtccagtagtttgaactattagattactaatagaaatctatgagaagattgttcttcagcaagttttccagtaaattatctctaggcaagaatgtagcaactgggtattttaaaatgtatttttgtagcagctattgacaaagtacagcctgtattgcttaagaaattttaacatgtagacatctaaagtgcattgttgaaataaaatgatacatacattccaagggtcaaggctgaccaatgtcagatttaagaatgtcagttggcagaagtggaggaatttgggaactagaaaacatggctatttgctcaggttaattctgaaatgggtggagggagaatcaatgagcatgtgaatccaagcagtcttcagacagaatttttagcagtgcactcacagtgaaagtaaaacctttagaaactaaaaaaattaaacatcaagctgaacaaataaataaagcaggaacaaaactggcataggtctggttttttaaagaagagaaccaaagcaggcagttcttagctgatctcctggaattcctagtaaaagaaagaaagaaaataagggtgcccacactggattatcaaatctgttttcttttccttagctctagggctgtacagaagcctccatgctcttggatatgtgtgccacctcaaacccagcccctcccagacgcttcagcccctgagctgcacccccacctggctctccttcctctctccgctacctggctctccctcccctctctcctacctggctctcactctcccctcccgtactgctggtctgggtgttgtcagttctttccattattatgggtctgtccatgccaccaccctgatgcaagcccctactgtctgctgcccagcctgtgggcaggaaggagcccctgggatg

SEQ ID NO: 294 - DNA, 130 bp, Homo sapiens
agcatgctctgtacacaccagctactgttatttcttattatttccttgctccctttcttgcctccattgaatccattttcctgcagttatcactttcaaataaactctgatcataacaccttcctgctga

SEQ ID NO: 295 - DNA, 651 bp, Homo sapiens
ttaagatagaagggagggaagaaaagaaggagagggaagaaaaatgcatgctggtacccttgcctgttctggaggccacattgccctgaggatttctgtcagtctccaggaaccatctcattccataagccttgtgtgcttttctcacttcctactgcctttgactcattaaggtgttgattctcaattcaattcgaatgtttgttcttaggaaaaatggtccttacattggcatgatggtgtgacctctgaatgcagtttatggcttttttgtgtgtttgttttatgtacagacattttgtgatttcaagaaaggataaagtgataggtatgaagttgcagggaaaaaaaattccatcaacccaaatccaaaagggttccttgcccagcacagcacagcagctcactctctggtatttctgcccccacactgaggagagacccacaggaggagctccagcacaagccgatggcaaaggaagggaaacaataggaggggagaacagcctcccacatccaccatttcaacctctcagagaaagtactgaaagtgaaaggagcatgaataaagaagccatttctctgaactaaaagcagaggagagggctcttcctcctgctgcacatgagtgaacaaagatgggctccagaa

SEQ ID NO: 296 - DNA, 284 bp, Homo sapiens
aggaagtggggtttattgagtgactactgctttgggctcctccctgtagtttaggtattttgctctgattgaatcttacataactatatgaagtagatttcattaccacattttacagaaaaaaaaaaaaaaaaaaaaaccatggatactccaaaaggcccaggacgaagatataaagctgcccagtggaaacacgctgtggctgacactgcaaagaatcccggctcagccacgtccttgttcttgtgcaagccagcgccctgcacctgaaggcccttatgtgg

SEQ ID NO: 297 - DNA, 63 bp, Homo sapiens
tttttttaaatgtaaaaggtgccctgtttgggataacgaatttattgtgtgatcaccctactg

SEQ ID NO: 298 - DNA, 812 bp, Homo sapiens
tattattagggtggcatctagagaggcggcagcaaggagtgaagccaagcttcccacttgacattcccaccttggtctctgtgaatgatgctccctgtagttgtgcagtgccagcctttgtggcttcagactgacccggcatgggcagcactagctactctagattagagaccatatgggggcaccacacttgccacttctacctctgcaccaatcagattcaccaccttctccttcttgggttacattgttgggactgaattttttttcttttactgaaaagtttagagcccagatttcttaaaggggaagaatgtcaagcagcgaatcctgcagagcatccctacccctggccccagcccatgctaattaagtgactgacttaaggaagttgcctcctcttagaaattaagaggtggattgagtattttcctctggcctccttaaatgttcttggttacagtgataaaaatgctgagctctattgcctactattggagtgaaggctgctggaaactcctcgttccctgaagaacctaattgtcgatgctagtgcatctaaacaggtgttctttagattacttttgctaatgccttttcactggaaagatcaatttaaatgttgctttgagctaattagttattgcttctgtgtccatccaaatttatatatttgattctgtgtgctggatgaggcattaccttcaaaatctataagcttacacaaggtaggtcattttaaatttagttatctgtcctcttctatattttatacaaatatgcatatatttcttttattatttaaaatgcca

SEQ ID NO: 299 - DNA, 54 bp, Homo sapiens
tgaaatgcctagtttaaacatatattagaatgtccagcatcatctttggatgtc

SEQ ID NO: 300 - DNA, 191 bp, Homo sapiens
tatacagagtatgtgttgaatgactatttgtggaacagataaactaataccctaacttaaatggcaaacagattagatttgttgtctctaggtgttttcgtttgggaatcctttaaatgttgcctaaactttctgtgtttattctgttctctgcctagaatttcctccatttcatctctatctctggaaat

SEQ ID NO: 301 - DNA, 154 bp, Homo sapiens
atcatggagtcattcttagaacaaaggatctggaaagggccacgtctagttttccagattccacattactccaggtctctgttaccttatctggtgggtatgtggagaatgtgaactgcttaaaatgagacagatggtatactctgctgaaccc

SEQ ID NO: 302 - DNA, 1665 bp, Homo sapiens
agtttggaagaaggatgtttaaaaaatagggtacacttgaacctattaataaaagtaattaatgtggctcttcaatcaagcccccaaaacatagagctttagaacctagaagttgtctgttcagactctccttttagagtcttaggatcttgtttaaggtcacctggctgaggaggagcagagtccagccaacaggtctcctgagtgctgttccagacatttcttcaggcataatttaacatgtatcagtttatccttgagtgtaaagtacacttcatgattgaatgcaggtaactggctattcatacttcccccaccccctttcttttagtgcctgtttctaagcagcagagttgtggttcagtgactctgtctgtataatatgaaaacagggcacccagccaattctgatgagctaattatttccctaaattatcatgcctaagcaaagggccctcaactctgctgttcaacacttatcattgtatttggggggtgagctgtacataaggcatatcatcagatagctagaattttctatttcagattgtcaagcagtgaaaattgtcgttcttagaaatgactgacaatcccccttcctcatttctgctacattgagttaggtaaagaaaaaaaaaaaagacttcagtctttttacagatctcttgctgaaaacacgtgacagaactatacattttcactagaaattgatggaaaaatgagcacttccaaatgcctgaaaaactttgcaaaggtcccacttaacagaatgtggctaacacctcaaaaaataaagcaaaataaatgttgcagtgggcatgaatcttgcttcaagtgctgggttgttggctggttgcctggggagagtggggccagggcttgccagctggcagagccacatgcctataaaggatgcagtcagcttacaccttggcaaactatgattttgatggaaatcttagaggtcagcagacgttctccctagtagagttacgttagctcaggtcattgcttttatttgagtgaagaaaacatcttgatggtcataattcataggaccaagtcattgccctgatctaaaccagagtttgttactggatctgaatagatagacataccctaaagaaggcacaggatgtaattgaaggtggcactttcaattactaatccccaagttcaactagtcatgccactgaagcacaccaactggctcatgagcaagcacacatctgccccaaagtcccactcagcagccattgttttcaaactctgagctccaaagctactaccatcctattctctgatgctcattcatattctgctttgtgtagttgttgttttgtttctctttcatagatctgaaggcagtatctccaaaatagctagcttagtgctttttagcaaaggaaagaactgcagagggagattctagatttcagagtccatgttgaaaattatagccattaatatttttaattgacaaaatacccatcagtctcccaatggatttgttggggtttttttgaaatggtctaaactgattctaatatttatttttctaaatattagaatcaatattggcatgcaaaatagccagaagaaatactgtgaaaaaattcaaaagacaaatatagattcggaaaaacatttgcaatactgtatatg

SEQ ID NO: 303 - DNA, 51 bp, Homo sapiens
tctttctttctctgtctcgctctctctctatctatatagattcaggatcac

SEQ ID NO: 304 - DNA, 21 bp, Homo sapiens
taaatatatatacatataaat

SEQ ID NO: 305 - DNA, 77 bp, Homo sapiens
gagagagagactgtcatataatatgtatatatgacctctatgtatgcaggtctatatatatctatatctatatctgt

SEQ ID NO: 306 - DNA, 55 bp, Homo sapiens
tcctgcagaaactcttccgaagggaacaatcagatgagtgtgtaatggtttatgt

SEQ ID NO: 307 - DNA, 219 bp, Homo sapiens
gtatttgtaagagtatgatcattttttggaaaaatatacgtatatatacatatatgtttacatatttttatacatatacacatatgcgtacacacatatatgtttacatcttcatgatagccatgatttatgcccttccagagtggctttcatatgaatggattgatagagcttagttttctgataataaatatgagggttttgttcaaacgtgcttaa

SEQ ID NO: 308 - DNA, 1993 bp, Homo sapiens
taaacagacgtataaaatttttaacagtaaagacttaatggagctgacatatttggatatggggactagaacagaggacttgaaagagaactcttattgatgcttatgtgaatactgcaatgatgaatgcatttttttcttgccagatatcaacctggataaggtctttagatttaaatattagtcagttgagaaatggatatacacatactaataaggaagttgaattagatgaaaactaacaagttttccatgctttaggctgcctgcattacgagtatatacaggtgacccttgactgacttacccctcagttggatattgagggatcattagaattctagaactgattgtataatttcagatatgtggaggagggaaaattgatgaagtgaagaataataagagagtaggttaaaaagaaactgtaaagaagtaaagaaaaaaatactgttttaatgctataaaaattagttggtggaggatagtttaaaattattaaagttgaatatagtaaatcaaattaccattaatattcgtgagcacgtggttgtgaaaagatggatgaaatgactagctaactgtctttttaataagactattggtaatagaatcagttgtggctcattattaactgtattaacagaaaattagcctacatgagcacttaaaaatatgaggttgttttaatagactgtggtcccttatcaacatatgtaaaacttaaaggtttataaaccatttctcttcccagaactaaactagattagatgatcaattaatggctaaaatgttattatatctctttttaatatttcttgttaaaaacttaaatattcctgattcaacttgtgcttctatttgcctgatataatttggtcataattggtttcattttgattgtctttacatttggggtacttattatcttttctctcatccactgggaatgccaagcaccaatttttgctacttagcaagtcagtgaggagcttcccactgagtgccttaattattgttaattgaatattgtaaatgatttttcaggatcaccatcctggcaatccacatagcatttttctcagttagcaaaagttaaagcaccaagtgtcccttctaccccttaccatacagtcatcaaatccagtaccagcagtaaccagttcctgtataaacgagccttctcttttcaaatgtcacatcatgtatatgcttcatacgacacttagaacatggtggctgctcaatgaatattaaacgacagctgtccttttatatagaaggagtcccagttccagtctgagaggaaacattcaatttccctttccagagctctcacggttcatctcatgtagcatggcatgcccggtaccccagggtagcactctcccatttacaggctccaggacaaagctttctagaactttttgctgctgtatcatcaaaaggaagcaaaaaagtagtaaataaagagcttcagaagatccgagagtattggaaatgctacaggcaacaaactggagtgactgagccagccttcttatgtacttcttgccttacaatacacaataaaaaagaaatgagaaatgtatgacctgccttttcagcttttcaactgtgtcttcaactttggagggggctgggggctaaggcttcaatggaatgaagttgtgttggaggttggttttagctacataaaattttgccttcttaatgatttgttttctggcccagtcaatgaaatttcaaccactgttatgaaatcaagaccagaagaagccttgagacataatttagagtcttcttccctatcaaggcagcccacagatcaacacagaaagaagagaatctgtcttagagagacaggcttccacaggctgtgattgtaacctattctataaatgacattttctgcctggactttcctcttatatgtagccacttgctattaagtttggcaggtcttagatttagaaacaaattcaaggcccac

SEQ ID NO: 309 - DNA, 374 bp, Homo sapiens
cccacttttagcaagtttctagtgttgagtgttacagactacgtggtactaattttgtccctgtgaaatagggacaaattctctttttttccccatttgcctacatttctcaactgtttgatccttttatattgtacatagttgtgtaaatcacctcaaatcttttgttatagagacaggtaagaattaatacatgattgaataaataaaacaataaaacatgccctcaggccgcagtttaagggcatttttgctggttctgaaggaaagctggtcctcattagtaatcagagcctgcctgtgcctcagccctttctgatgagcaatgctctgaccacacccttttacctcccacccatcatctgctttggtga

SEQ ID NO: 310 - DNA, 395 bp, Homo sapiens
tcttggtatgtatcaaaatattttcttttcttcctgttttctctcaattataaagtttttacctgctcacttagggcttttctgtttttccaataagatataaaaattattgtctcgtagaatgatgtttgggaacagaggtttagtagaaaccaaacagaaaagaataattattcccatctacttgtctccaaataaatactggattaaaaattctaaatatttatggaaggagattccctaactttcttcaatgtcttgttcaatcttcttacaagtagtagaacttatctgccctgaggctccactgtctaatatttgcagatactgagcttttccccctccttttctacttgctttgggtagaatatctggcttttgacttcaatgcaatt

SEQ ID NO: 311 - DNA, 1736 bp, Homo sapiens
gccatagactggaggcctatttgtctggaaggaatgggaggggaccatcagcctgttttaatatgtgaggtagctgaactttaaactttgcacacggtcaaactgacacacagtgccagagagatccagaatttttggtcattccacctcctacaagggaagaccggtgactagtgtgacgaaaatatagatctcatgagggttttgccatgatgacatgtcttatgtcaccatattagccactgtccctcatttattggtgtttccttgagcctttagaaatatgtaaacatataaacccctagaaatatgtaacactcctatgttttcattactttcacattctttgggcctagaatacccacctgctacaaagagttcataactttaaataattcatgaatttgtcagtgtctagtttcttttgtaatcatcctaatgacaaaattcactatacagcaaatcaaatcagctgtgcatcatccaatttggtcaccagctgaaaatatcagaacttttccctttgaatatgtgtggatgctgatgtttcaagaaatattattcagaatcactgtgtgatatacttggactatagataatgcctattaatggtggctagatttgcctgctcattcttagctttatgaacagttaaggcctgctctgctgaggagttcgtggtgttaacatctcacttactttccatgggagaaccctagctgcttaatggcactcatgtatagaaacatcctggatattcatgcctctaactgtcccatggtgctttcattcatcttagctgaaatatcctcccttttctgtgcacctttcaaggcccagcttacgtctcccctccttcctgaattcttttctgacctttccagccctccctgatcgccaattctttcaaatttcaacagcctgagccatccataccagcttacctctttatgataagctgcaatggatagcttcctgctgtttagcaggtcagcccctcagccaaatcacatcctttgaaatgggcagagaccacggcctttactatggctttgtgctctacacaccttgcatgaccacattcatcttgattcaaaaaaatattgtttggttgattcacttcaattctattttctttgcgtgtggaaaagcaatatgaggcccagtcaccatcatttctataggaaaatctagaggggccacgaacatttcaatagttctgtaaaagaacccttattcacccaggactatattgcagtagggcagcctggagagagggcaggcagtttcccaattcttcctaaacttgcttcattaagtcattctaagggaatgttcagatgctctgacatcttcatatttaaacataagtataaaaccccctccgaaataaaaccaaaatgatttttttccattatccttctgagtgtggccaagtgagcactgaccacagtgaaactggctaatactaatactgtggtgtcatcatcgctcccctccttcctaactcacaggaggaaatcgcagtcacatttaaaaagtgctctatcatgatttgagttgaattataactagaagatcttcttataatttttacatattctgaatgtcaaagatggaaaattactcttaccgtgccattcaacggctccatgatttttgacaattaaagttactgtggcattgcttacaaccggtaggcttgagtttgtaaagcaagccctgttaagactggc

SEQ ID NO: 312 - DNA, 693 bp, Homo sapiens
ggaaaaaaagactggctaatttcccctaagccccaggactgcaaattaggttgctgccaccagggttttcacatgactcaactgttctccaagctctctctgctgaggcaaagcatttagcacacaatgcagtcaataccttcaaatgagataatgagtgtgaatgggcttggaagtgtccccctcactgcaggggacctagctctgacagccatgatcagagaatagcaaagactgttgtagtcctcagccaggctgaaggactccaaggcagaggaaaagaactctaagaccatccgtttctgtatttctgccccaatggctattccacatagtggtccaggaggcagggcagagaacctggaagtagggggcaccaggaagtagtcacatccaagtagggagcacagcaaatgctcaagtcccagcagcacttcctgcccggggtgggcatcagtgaggtcaggctggagaaatgcaaactctggactggcttggtcactgctgttctgttctgatgaactctcctttgaaggcctcttgcaccactggccctggggcacatttgcaatcgttaagacagcacaattcagaactgccttacaccaaactgctggagcataaaaatgagaagaactgatgaaagggaatcagaagccttggatgaccgctccatgccatgggataccacag

SEQ ID NO: 313 - DNA, 165 bp, Homo sapiens
ccactacgtatctgccacatcagccacgagagtctgggttaattttttaacttccccaaatcttacacgatacttatttcacagggttactggtgtaagtaagataattaatttggaatttatctgtaaaatgacagtttgcactggttgaagtaaaagttaaag

SEQ ID NO: 314 - DNA, 269 bp, Homo sapiens
aaaacatacaataataatctttaattacaaacttccgatatgatgtaggacaagattttagaaagtgcaacacttaggaagcagcatatttgtgtaagttaaagctttacatacaagttacaatactcttaactcaaactggtttcaacaatgaagtgagttcattgttaccgagattaaaaaggccaaatagagtgctagctgaatccagccagctgaattgagagtcaaggcttaatctagcagctcagacagtgtcatcgtagagt

SEQ ID NO: 315 - DNA, 99 bp, Homo sapiens
ttaacccaggtttgctttctctgcccagtagttttgtgttggcaagcttcacccgcaggcatcacatgatacattttccccacccacttcctgtagctc

SEQ ID NO: 316 - DNA, 246 bp, Homo sapiens
catgtggccattccattcaggaaaattgatggacttaatcaatcatgctcatgtcgagagtgagtttgagatcattctacacaaatcacagagctgagtgttaggaaggggtgaatatccccaaggaagagtcagagatcactggcagtagaagaagtgaatgaatcccgggaggtaaggagagtgctccaggccagggcagaacggtgacagtgctggaggaggaaccggctgacctggcttgta

SEQ ID NO: 317 - DNA, 1058 bp, Homo sapiens
atgtttcagtttcatgtatggctatgttctgtcattagtcttcagggttatcaactgcaggtttattttcttacctgattttctcagtaggcctaaatagaacttgccttggctttgtttctaatgctagaaaacttccaactctggtggagatttgaaatatgccatcttctattaactaagtcatattctttaactagccaactttcccctacagtttacaacttgtgtcagacacacggaagatttgcttttggtttttcccttgtgaacaaaacaagtcataaaaaaaattatatcatggtttccttacagttgcatttcatcctgcatttcttaaatcaagaaattgactaacataatggctgaatgaataagacaccacagcaatgaatgactgcctttagcaaactgagagggagtctcattatttaaatgttcctggttatattaagtggagcaaaaggcttggaatcaaaagtgagagaaataggcagccaagtcaaaaatgccaccaagctgtaaataaaatatgaaactagcttagaaagggagcattacttcgaagtccaacactgatatatggtccataattgtgggacgtttgtaaaaggtgacatgacacctgtcaattatccacagcagccaggaaatgtagattacatgaataattcaccaacccagtgccctttgttgctaagctgtctcagcccagttccataaaataactgctgatatgaaagaagaaaaaaatacgtttaagttgcaaaagccttatgttacacgcggaaatgttttcaaggcagcttcatcatatgactatgttccagttagcaccgttggctaaataattaacatgagcctttatcaggtgtaacaaaggagggggctaggactctggaaactttatatgttccctttgtggcaggtggaagcagggggtgccgcataagagaatcttcagtatcagaaacacatcactacatatgtcataattttctcatcctcccaaacagcacacgatcctttaaaaagtctaagtctgtgtttttgttttg

SEQ ID NO: 318 - DNA, 96 bp, Homo sapiens
tggtgagcaggattatagaggatggcaggaaactgcctggtcagcagcccctactctgcaccccactccccaccctttcccaagcacttacaagga

SEQ ID NO: 319 - DNA, 1237 bp, Homo sapiens
tgcaacacacatacacgtgtaccactgtaagtacagcttgtctacacagccatgtgagccaccaggatttggagaaataccagttctgcagctcccgggacggcacaatagagcatgaggcatggaaacaactgactctttcatttgtagcctgggcccaggcagcctgatacctatacccaccccgctctttccccacacccttgctggctacagggcctgggtcagaggtcatgggccaggtggaaggtggggccttggaatgcccaggggactgggcaggcagccataggtaaccagagccagccatctaatccatctgcttccctggactgctgtgagaaaaagcctcattggagagacctaccaaagtggctgcttccaggagcaaatccagccacactgtggagaaagattttcttgcccttacaaggtggttcattccttgtaacttccttccttcaaaatgaagttccagcagacaaagagaacaaaaaagaggtctgtttctcatggtttataaggaaaagaacaccttgtagataaagtacagcctttcccatttttcagaagcaaatgagtgtttctttctcatttgaggcttatttgcagccaaggtttggctttgtttttgaaagtttggaggaggttacattcttgtgtatacccactgggtgcaagtgctttggcacaggttttctaatatttgctgtttttctccaactgtcccaaatggtagtttatagtatttcagctctttcagaggccaacctacagggaaatgcaatgaaaagggaactgagtttctgattcaggtgaaaggcaactgtaatttcaggctttctgcatgtatctctttgcaatcagtcattacttttgaaatgaacattatatttagtcatatgcagaaataataacaaactgctggtttcatcgtgaagatctgaagttgaaaacttcatgttttaacattgaccattccaacaagcgtaaaacaggagacatcgaacatcttgacattacagctgcgctgagactatttctccagtgcatatgtcacaggatccctttgacagcgtggctgagagggtttctttcaacaaatggaggtaattgttaaatgaatcaatgattgcctaagccaattaatgccttttctaataatgctgaaatgtttctcaagaatagtctggaaaactctttcatagtaagagactggtggagctggagcagcaga

SEQ ID NO: 320 - DNA, 40 bp, Homo sapiens
cagctaccttgtctgcctggaaaaacccttgcccagttgg

SEQ ID NO: 321 - DNA, 220 bp, Homo sapiens
ggattttatctggcaacgctgccagggcaacttgtgatgggttgctggaccttatggggctgtctgagatgccaagcgaaatcagtcttgggatccatccatttgttctaggacattaacttctcgaagcacttgtggattgctcatggcagggcgatgagtgggctcctgttccactcttcagtgcccagtgagaagcctgcggtgaggcgttgtcagg

SEQ ID NO: 322 - DNA, 44 bp, Homo sapiens
gcaggcgcaagacagcagagggtgtgtaagaagcatccacaagt

SEQ ID NO: 323 - DNA, 646 bp, Homo sapiens
tgcagttattattctgagagtagcagatatcaaccactgtagcttggcaggctggtgtatcttgaacacctgacaactaagtgtgttgccagattttgatcaatgtctagaatatatttttcccacaaaggaggctaaacattatcatccccttgtgggtttggttgttcttcagcactgagaagaattatgttggttcctagctgcagtctttcatgtaatcaagaggaaaagcttttcatgccccattgaacacgtggtcttcctttggaaccagctcgatgccctgaacttcccacatctccctctcagccagtcccacatctccctctcagccagtaccctctgtcctgagccaaaaggtacttagcttgacactattggctaacattgaggtgaccatatgtatccagttgtagcaaaaatacatcttacatattgatcagaagacaaaaaccacatatatctccatataccaaaattaacagcaagtttcttcaattctctgaaacttgcttctttggcccagtgttcttaatttgttaatttatcaagaaattataaaatttgaaagtgggcctcaaacacaaaattgctgaaaaatgctggcttaaacagccacttgagcaatgctcctttcacaaag

SEQ ID NO: 324 - DNA, 40 bp, Homo sapiens
gttttcatgtgtgtgtgtgggtggtttttgtgtgtgtgtg

SEQ ID NO: 325 - DNA, 409 bp, Homo sapiens
gtgttgaaggaataagtaaacaaacaaatgagtatgtaatagctgtttaaaatgcactgcaaatgataaagtaccatggaaacatggctggttattaaaagctgacaattttattgctgttttagacttctcctgccctttaggacattatgctccaaggagtttacatttttttaattgaaaaattttcttagtcatatctatattttcttcctctgacataaaatcttccagtgactttttatgaagatatttgggtgttgataggaagagggcagttaatgcacataatatgaagtctccactagccagaagacacatcctgatagctcagtattccaaacttaaaatgaacccactgcatgaaagctcaattcctacagaaggtagaccaagggaactgtttttg

SEQ ID NO: 326 - DNA, 900 bp, Homo sapiens
ggggactgttatttttttacaaaaaagggatctataagccttaactgtcatgtgtgtattattaacactctgcagccatggttctcctctgaaaaaaaaaaaaaaaaaaagaactagagcatttctgaggggatctggtgctatagtctatcctttgagttgattgatgacaaatgaatcctcgcaccttctgttttggaaaatacaaatgctggggatgctccagctcaggagatcttccaagggattttgaggctgttctgacctggacaatgctagaggagaggataccctgggcttcctcactttaccaaagagaatccaggcacatccttttctggcagtcttgaagggcctaactatctaagaaagaatcttcactccctgaaatgattctcagtggaattctttaaaatatgagttatcatagtacattaaaacatgagagtacaaaatgacaacaagtgtggacttaaggaaaggatttatttttccttttctttctcttctatgttttctatatgtggctagagtggtcttacataaataaatgaacaagacaatttatggagccccaagccctgctcgaagcatgctatatatgttatttcctttaaggagagaaattaaatgtgatttccaaaagttgttttgtggaataattgaggaagacattattgttctacctgcaacattaggatgaaagcacagtgagctataatagaaaacctgccacgttatttccttcctgtttcaattcttgacttgtatgttcctaggccagacttcctggaggtgagcagccagagtggacagcgagagcagcaaagggtaactaccaccttgtgagtgcctccaggcaagctgcattctaggcatcttttatcacgaacaaatatc

SEQ ID NO: 327 - DNA, 42 bp, Homo sapiens
aaccgaaaccccaaccccagggttatggagcataatataagg

SEQ ID NO: 328 - DNA, 1014 bp, Homo sapiens
tcaacacacagagtctccacattcagaatggcacctgcagcctgtttgctgaaaacggatacagtagtgacagagagcctggagagcagagaaaggagaggaaatgatgcatgtgggacagggccgggaacagagaagaggctctgcggaagacaggagaaagggaaaggggaacggcgctgtgctttgtggagcaatagtggagatagtgcagctttccaggacacaaggagagaaaacaaatcagaaaatgggtaaggcagagagatttaacagaagcttggggctaggggagaaggcactggaaggggaaagaaggagaaggtgaacaaatgatagaggctacagtacaaatgtctgggtgagtcccataccaccagcttatggaaggccagcgttgggtgggtgaggtgagagctcaccatgcacccagatatcctgctgttgcgtgcagaagaccacacactgcagcaccaggcagccctctcttcatgagggtcacacacatgtgaggattgtaagacgaggcccttggggctctgttcacaacaaaaacattgtacgagccttttacacatgactcagtgtgtattgtgtgtctgactgaaaaaagatcagctttacctacaagtgctaacgtgttggccgagttgaaaggagtgcacaattacataagaaataaaaataccaggggagcaagcagtttaccaccttgtatgggacacgctgaatctccagaggaaaagtgccaggtgactcctttgccaactgtgagaatagctgtggttggaactgggtgttttgttttgttttgttttgtttttaccccagtgtttggcacagagtcctgaacaccaagtgaggcccctgaaccctgcttgacaccagattgcattttctaatgtcattcctgtttcacttcatttgagaaggactggataacaacaaaagaaaaagcgaaagagtaattaaattttgttgtatgggaaaagtttatgtgctaagcctgcaaaa

SEQ ID NO: 329 - DNA, 47 bp, Homo sapiens
atctttaaaacgggaaagatcccttcccccagtttgctcaagggagg

SEQ ID NO: 330 - DNA, 137 bp, Homo sapiens
ggaggataaggctgaaacaaaaggttggcaaggtggaagctctttgaaaagcacttattaatatctgttttatactgtatgcagtgtggcatagtaaaaactatattagatgaggaattagaagatgtggattctgg

SEQ ID NO: 331 - DNA, 361 bp, Homo sapiens
gtgcccattcattcccttgcctacctgcagcaggaaggccggagaatctcccattccctgctggcctcccagagatctagctgatagacttaaaaaagaaaagaaagaaaccactcacacatacctgggaatatatcccaggtactttaagtgaaaaaaaaagataagttgaagtactatgtgtaattctaatatataaacattccataatatttttggaaatatagatttggtagaaactatctcttaggcaggattgaaggaaattttactttagatcttacacatttctatattgtttgaatctcatactgtgagcaagtttcatttgataatcaagataataataaagatgtaaaaa

SEQ ID NO: 332 - DNA, 2472 bp, Homo sapiens
cccctttgtagtattgacaggcttttggagaataatgaaacgctgaaatgtttggcttggtttccctcttgggtagagtctgctgctcagtcttttcttctgcctctttgtatcctttagcttttgggtggaggcccagagagctccacaaggggtgatgtgtgtttaagaaactcagctaaaggaaacaaactgattgcaaagaactctgaacctagggtgttgggggaaatgctgagcattgtaattggcctaatgctgctcctgtgagagatgccatctccctaggcctccaaagttctggcagggattttaactcttctcatccagctgatgacagacaaatattcatcacttcaacagttaggtgcaacccccaaaatgtttcctcaagtccttcctcactgcaaatgcctaccagctcatctctgaagatggaaaagcaagcgtggtgacatctgcaaatctggacagtgggctttaggattcatctgaaaagaaaggctcttggacagtgctggaccttgctccctgagccaggctgtgggtccagtggtgactcaggaaggaatgccactgacaagccacaggcatgccagagaattactcagcacaagccaacaagtaacctcatacgagaatcaaacgccagccaatctgcgaacgctttgcgtaacagcatatttggatttggggcttagctttcaggcttgagtttcacgtttgcctgagcatactcccagcctcccagggccccttctgtgtgccctgcctctgattgcaagtgcagagagcagttctcccaagagccagggctcagctcacccctgcaggtaacgcagacctctgctagggatcagctgtctatcatctggtggcgcccctctttccagccagcgctacatcttcatatgccttttcttaccaacaggtcagcaatgtgggtgacagatacttctttttgctgttggaacacttcatattcatctctggtattgtcatggcctttgacataccttaccaacaagagaggtttgttgactgatgacagcaggtataacaaaatctaactagtgacagttgtaagaattggcaaagtattactgcatcaacaggtatgtggactgtctaagagcctcagaaaggacaaagaaagaagcttacagattccgatgccccttactactgtatctggcctttctcctgccggtatagtgagagttgacagtttgatggatttaatttaggatctatgttaggatgagatgcactctgttttcctaaacaaatttgctgcagaatggcagccacagtctagggcctccttgagcttgaggctaaatgacctgatggcccacccacttcatctatactgcctttaatatgtcagcatttcctcaaggcctgggtttcgtgcactcagggtgatattgaacatgaagttttcaaacagcaataccttgggtaacagacaagggctagttaatgatctcattcataattcatcccgtgaaggaaccatttacactcaaactccaagcaggaagaaaatattcccattaggtagggctttttaaatgcctctgcctttgccacagtgctgagagagaactgtggtcttcagtagtaagggcatatggctgcaaacagagtgcccaggttagagacaccaagagctgcagcatcactcagtaatagctatttcagagggatgtaaagccttccctgggaaaaagttgaataggactcagtgcctaaacacagcactttcaaaaagaaatgaatctctaattaaacatcctgaagacagaagctgacatgtcattgcagagctaataataagacctcatgaaatgttcaaaagttctccagagtaagtgtgaacaattacatttccctctctccatcagtgaagggttaccaccagttctttaagaaagagaaaatgaaggttagtatctgaaagtattatataatgtgcttattactatgcgtgggttgagatattctccaaaaaaaagttccttttccttccagaattaaaaagaacccctctaacttttgttaactgtagatagaatcttttcttttttttttaaggaagaatccttactgcatgtctaaaactcgtggctgagaaaaagtagaggatgtccagcctaaggagctatcagcatttttttgtagcactcgatatagctgcaagccaaggtcctcacgaaagtgaaagttttcattcaaagttaaaaacatactacttgcattttacaagctcaagagtaaagcacaataattatcagtgctttattggtagttccaagcctccaaaaatgtcagtaagttgaatctacactatctttgtacaagaacataaaacatagcctcgtgataaaaattaaaggaaaggataaatttggtgaattccctgcatagttcataatagagattagtcaacccaagttacaaagataa

SEQ ID NO: 333 - DNA, 51 bp, Homo sapiens
aagttacaaagacaatttttaaaggtttaagaggtttgcttcaaagagcta

SEQ ID NO: 334 - DNA, 1181 bp, Homo sapiens
tggctaaagagctatttcttttatataaattatatgaagattgctaaaaggttttaagtcacactacatgtaaaaaccccttaggctcaaactcaccaggaggatcgtggagcttggagctaaataaagcccaggtgctttgccctctgctgctgacttcgggtgctggctgggaaggatctatttccaggagggacccagcagaacctcggcgtcccacggccctaataggcaaatatgagccggcctccgccccttaaggatggagctgcttagcttcgccactgctgcctggagttccttgtctgagataggcagggcgtggtgccccaggtcatctcccaggcatgcttgccccacgagcagcgctgtgagggtgtactcaaggcaatccaagtttcaacgtcataccattgtctttaacaaaaccctgcaaacatgtagtgaccgaggcatgatgcatcctgcctcttgctctgctatttatctgcttttctttttttaactttaacttgttctcctcctatttattgggcaatcacctagattctaggaaacaaatatatttaatttttctaatctaaaggttaataaggactctatcttctctagtcagagccacaggatgaactttctcaacccatcctctttaaggaaaagaagttgttggctgagtcacgtgagtgtctgtttacacacgtcttataacagcatacagggtacatacacagagcagcacacctccccaccaggaaggctgtgctccatattcatgtgtcaagtgatgtaaaggttgccatggttataatctctgtttagtcaatagtgtgtgtgggggggggggcggggaatcaccccaatgggcgtattgcaatttagaggaatccctgggtacttttaaagtattgaatcacaatttacattttaaaaagtgttgtcaatgacagcatattggttgccatttcttgaaaactcttctttgtaggaggaccttatgtatgccaagaacatcgtttttgcctccttaggtgaaactttatttcccacatttaggattcattaggattatctaaggtaagtggcaagaggggagaaggatgaaaatcatgagggtgaatgtgggaaagggatgagggaaggtgagcttaattatttcaaagataataatgagtgaggctccc

SEQ ID NO: 335 - DNA, 38 bp, Homo sapiens
ggaataaaaataaaagtgtcagtaattcttactcttct

SEQ ID NO: 336 - DNA, 584 bp, Homo sapiens
cacccaatcttattcatattctagtcaatacacaaagaatctgctgtgcttttggatagagagaaatgcttcataacaacaccatcacacattattgaaaagattttggtgtgattagggccgactgacatccaaacttccctcccacctttctggtcatatctcctccttttcccacactcagtatctttcctttatctactctaagcagtaacatgataagttatataaattatatgaagatcattaaaaggttttaaagtcacactacatgtatgacttcgtatttgaaaaaggctcaaaacagtaagtgaaaaaagtgacagttggtggaattttagaagttgagggtggaaggtgtttccaaaacccctcaaatcacacaccctagatgtggctgcttcctggatccactagtgaagctgactctggcagggagtcacttgcatttttcactaactgaggtcctgctctctcaaatttcacaatctaagggagagaatcttgatccagagtgataacaaaacaagtaatgcaagctcagcgatgtgggataactcccctgtccctggtattagcatgga

SEQ ID NO: 337 - DNA, 647 bp, Homo sapiens
gaaaatgtgtatgagtaaaaggaagagataggtatgttgacagaagacagcctgaggagtttagagaatagaaacatttctcaagaacttgaaagcgaaagagtctcttgaaagggtttgttgcacactgcctgaaggctgaggtatggactggaaagtgacttagtccagccccttctagctgggtgagtaactgaacactccagcgtgcggatcttcactggagagaaatgggagcatgattcatctctttgacatcatctttagatttttggtttaacttttcctttccacatcagacgcccctgttgttgggtggtctgccatgccacttcctccaagtcccagctactttactctaggtagagggctgagggtaatggatcttatttcaaaaggagaggggaaattgaaaccagaacagctttgtgatgaactgtaggggaatccttttttctctagcaaaggtttcccaaggctggtgtctccagcttggagcttgatcgtgtgtggtgtgtgtgtgtgtgtgtgtgtgtgcatgtgtgtgtgtgtgtgtgtgtttgtatttggtgagagttaaccattcaaaatggaaatcctttcataatttgatctagttatgcaaacacagcccattgatgttaaca

SEQ ID NO: 338 - DNA, 64 bp, Homo sapiens
acaccatacctgttagtagtcactctgtattcatccttcccccaacccccggcaagtgctaatc

SEQ ID NO: 339 - DNA, 101 bp, Homo sapiens
taataaagtaaaataaaatatgcaacaaatgtcccttgagagaggcatttagcactgggagagtttaagtaaggtcaaaaaagacaagcctttcagccagg

SEQ ID NO: 340 - DNA, 215 bp, Homo sapiens
ggccaggcctatcaacctctctctctccgtttatcctcacctgcttttaaactggggtcgctaacttaaaaaccaaaccaaaccatcttcaacctcacactctcctccagctatgaccccccttcttcctttcccaattaaacttcttgaaacacttgtcttcactgactgtctttgcttcacagattccacttttgctagatcaacaatacatc

SEQ ID NO: 341 - DNA, 468 bp, Homo sapiens
agttcccatctaactagagcttgttttccaggacttgccactccgttgttcctgaaactcccttcccttgacctccatgggccaggctttcctggtttccctcctttctctattaattttcttgtttggcttcttctcaacctgtatgttaaatgttggcgtcctcaaggtagacccagccccacttcgtcctctgcactctctcccttggtggtctccaacagcccatgcctttaactaccacctatacaccaacctaacgtccatctctctgacctccagatctgcttagcagtatctcacagtgacctcagcatcaagatgtcccaaatccacccctgaccacctctgcagatctgacaacagcatccttctttcggctgcagacaaagccagcatcctagaaatagcctgtgactagcctccctctcacatctcctcaatgaacaagtcctcaaaatgccagct

SEQ ID NO: 342 - DNA, 266 bp, Homo sapiens
gaaactccagcttttaaatatctccacccatttctctctgcctctgtggtcaccatcctaacagatcccttgtccacctccaatccctgccaacccattcttcacactgaagcctctctttcatccatcctctcgcctcattcaaatctttctggggttgccactatatgccagaaagattttttattaaatacagatgcaatcataacattcatctgcttccaaacctttgaaggtttgctactgttcttaggataaaatataac

SEQ ID NO: 343 - DNA, 42 bp, Homo sapiens
tgataaaatataactttctcagcagggcaccaatgccctgtg

SEQ ID NO: 344 - DNA, 48 bp, Homo sapiens
ttaaatggtatgaaagctatttatctaaggcaacaacctctttttttt

SEQ ID NO: 345 - DNA, 22 bp, Homo sapiens
aacatcctcattttacagacag

SEQ ID NO: 346 - DNA, 378 bp, Homo sapiens
aacagcagcccagagggaattaatactcccatttcccaggagacaagagttttagttgcgtatgcaggtctttaaccctggaatgcttaaaaaaagcactgatagagcgagaaaatacataccttactcacctgctacaaaaacacacctgctacaaaactcagaaacaggagcaagctattctgtccatgttgccacctcctccttgctaatgtgtccccacattgctgcgctggagggactgtgtgctaatctgtccccgctctgctggtcagcaaggacatggtgctatgggatggggcgtgctatctaaggactttgggagggaggccagaggatttaaattacctgcaagaggtattcgtcattcacttgaga

SEQ ID NO: 347 - DNA, 42 bp, Homo sapiens
tcacttgagatttatgaagggtcttcgaggtgctggttgggg

SEQ ID NO: 348 - DNA, 83 bp, Homo sapiens
ggggttcctggcctgagccaaagagcaagcaagagaagcaaaggcatttactcggactcgttgggagtgcacaggagagcagg

SEQ ID NO: 349 - DNA, 313 bp, Homo sapiens
gtgtgtacctgtgtgtgcagatgcaccctggggaagctggaggggcaggaggaagctggctcaaaacagaccactcagagctcccacctttccagcatggaggatatctgaggcccggagcctctggaggtgcagcatgccccatcccatagcaccacgtcctccacctgatgctggaggtcactgacatctgtgaacctcccatccctccccatccttgccacctggcattgtagaaaaaaggacacttgctcccaatttgttaaagggtctgttctggtctctgaagttaggagaaaagagaaacaaatgg

SEQ ID NO: 350 - DNA, 76 bp, Homo sapiens
gtacataaacagcagtaccatttcagctatgccctctcttttgttttcgtatatcctaagcagaagctgaactccc

SEQ ID NO: 351 - DNA, 34 bp, Homo sapiens
taaaaataaaaatatatttccaggctaggcagag

SEQ ID NO: 352 - DNA, 25 bp, Homo sapiens
ttttcttatcaactgatgaccattt

SEQ ID NO: 353 - DNA, 46 bp, Homo sapiens
tgttctggtctctgaagttcattaaggagaaaagagaaacaaatgg

SEQ ID NO: 354 - DNA, 267 bp, Homo sapiens
atccctaatgaaaggtagtggaacttgggtcgaatcctcgaccactctgaggctgttaccgaaagtctcaggcagcccctggccttccctccaggagtctagaggcacctcccagaagcaggagccaatccctgtggctggcccccagtacctttctcatgtctgaactttttacaataacttcccagtttatctccttgctggtctctcttgttgccacctcttctttatcctgctgtgaatatctatttttctaaaacacatctg

SEQ ID NO: 355 - DNA, 48 bp, Homo sapiens
ctcatctggctcttgccagtctctccacctttaaagtctcttatgacc

SEQ ID NO: 356 - DNA, 182 bp, Homo sapiens
cccacaccaccaacacccctccgtgggccacaatccgggaggtgggaccgcccttgtgaagccaccaggggttcctcccctggggcagggcaggagcttgcagagctgttgggtggagggaaagggagactcctcaccacacacgcagaagtccctcagccctacaatgagagccaaggaag

SEQ ID NO: 357 - DNA, 686 bp, Homo sapiens
tccgggctcccaggggagtccatcatgctgcgtctgcagggggtgggggggatgagctgtcggtggagcccctcgacgggtgggggacgggcaggcagccaagcgcacaagtgcagcccggctgacaggaagccgcactaaggggagatctgcttgggcatccaggacacaaagccccacctgtcaggccccccacgcacaccctccacccgccgtccgggtctggccccgagcccaccaccagcagctgcctactcccttcctccctccctcggtggcctttggtcctctcccgggacagctgcaccaaaccagcaggtgggaggttgtttgcacgggcctcccagctctgccccccaacagccagcttcaaattccagagcctccccaggaaccagcagcagagagtggccccgtggccccggcgtgtccctgacttgggtgacaagcagagcagcagtgcttcctactgaccagctgaccggggctttcatcaaggccccctttgtcctctgaggtcccctggctcaggtccaccctgcagccacgcgcaggacccctgtctactgcagagcctctgggcagcctgccggcagccagtcaccatgatgtgaaagcaaacaaacagagtgtacgcccaaagagagacacaggtgggcctcgatttctgccttataataaaggta

SEQ ID NO: 358 - DNA, 19 bp, Homo sapiens
taaaatatatttaaaaata

SEQ ID NO: 359 - DNA, 26 bp, Homo sapiens
ggtaatatcaactcactgtagaaaat

SEQ ID NO: 360 - DNA, 384 bp, Homo sapiens
aaaatgttggctgtgccgtggcattcaaggacacgctccttggagtacagttttcgactgcagctgtgcctccacaaagaaaccacaagaacaaatccagggggagggctattgttgaaagaggtactccgatacttctcccttaggtatctctctgagcaacctcagccaggactggctgtgggacgagggatgtcaactaagtggattgtgaggggtgtgctaaatggcattcagcacagaatttacaagtggaaaccttgtaaatagtgtcatcgtcattcgtcactaggcacacatggggatctgcgagccctggctcccggtctgcagccctgatggcatgatttgattttattttttttccgaaagagggtctttctt

SEQ ID NO: 361 - DNA, 198 bp, Homo sapiens
tgtgcaagttttacctcaattacaaccaaccaaccaactgctaggcacagcttctaataagcagccagcagtttccagtttccgttgtctccccccgtcccaattccactccccaaaggcagtcttgctttttaacctcttttcccttctggccagtaatgataaacttgatattttcaattaatatatctgcattcc

SEQ ID NO: 362 - DNA, 182 bp, Homo sapiens
gtttttcttggagtaactcctttgttgttttatttgtacaccttcctttgtgccacagacattcttttcccaaatatcccattgtttaaggcattctgcggggcgcctggtttccaggaggcaccccccacgccagtgcccttggtaccgcactcacttcttctggctgtcatcttctcttc

SEQ ID NO: 363 - DNA, 46 bp, Homo sapiens
aaataaatcactccctgcactgcaccaatgctgatgacaagcaata

SEQ ID NO: 364 - DNA, 154 bp, Homo sapiens
tttattatgctgggcatgcgtggtcggcagatgtgtttctggttaatgttcttgcacaacttcatttccttacctctattgtctgttttctctttttgccactccaaatactttcatactgaaccttctagattgattctttctttttttcttt

SEQ ID NO: 365 - DNA, 315 bp, Homo sapiens
atgtcagattgtgcaggcttttttttctgagaccttggtggtttctgcagagacgtatcctctgatcacctggatgggaagtggatgccagatggcttgtacttggctcatctggatacaggaaatgttctagactttcagttattctccttgttttcagcatccgctatacccaaacctctgccacatgaagtctcttgaattaggagctctgggtcagcttctccagcccactctccactgctccaacccaatgcagttgtaggataaatacttgcctgccgatattcagaaggggttgtggagcggtaccag

SEQ ID NO: 366 - DNA, 116 bp, Homo sapiens
ggtactggttcttagacatcctctccacctgccttcagttctgcccccgtgcctccagtatgatgtctcccagttcaagtctctcttggcatttgctttcctcctgtcagcatctc

SEQ ID NO: 367 - DNA, 193 bp, Homo sapiens
tatcatttcttcttttctttccaaaatgtgttaaaataccctatttgataatgatccctctctcattttctttgtccttgtgggtctttctcattcttatttctttactattatgcatgcagctaatcttgggaaggtgtgtagccattctgctactttagctaaagccctttctcttccttcctttccttcc

SEQ ID NO: 368 - DNA, 228 bp, Homo sapiens
cagtgtttttctcacttgcatatttctgagtgctttacaactcacaggtcctccccccatcccaaaatgcttccttctgccttcccaaggattttttttttttaatggtttgatttttctcttcttgaaacttaactttttaagtcgacctggaatttatccaggcatgcagcctaaggtgagaatctaaaacattctcttctcaaaaacagctaaccaaattagcct

SEQ ID NO: 369 - DNA, 27 bp, Homo sapiens
aaattaataattttttagtaaaaaaaa

SEQ ID NO: 370 - DNA, 113 bp, Homo sapiens
ccagttttataactatcaacaggtctattctatgtaaagtatcctcccaagtcacgctttatcctttttcctattttctattcattactattaaaagactaagaaaagtagat

SEQ ID NO: 371 - DNA, 285 bp, Homo sapiens
tctattatatgcaaggagcgaggaagataatattccaatatatttgtattcacttgtaggtaaaaataaaacacttggatggacacaataagagatcagtcaattagtggttctctctctcttagggttgagtgggagctaggcagtgggaggtcaggagtggaagggacgcctttcactttttttttctggaaccacttgaatgtattacctatttaaaaaatgaaatacattagcagatatgcagtaactatgttttaagtgaatgacaaaagatttcatagg

SEQ ID NO: 372 - DNA, 329 bp, Homo sapiens
gctttcaaagattcttacaaagatattttctggtcttgctattttggtgaacaggatgttttctactacaaactagttgctgatatactagaaaatatactcttgatttttatatagctcactcccagtactcttattctctatggtgaacttgtttattaattctaagaccttttttccatcgatctcctgggttttcagtggatagaacaaggttctaggctggttccatcaatgtgtttcggcagatcaggatagaaaacggggatggtgacgtctgtggggaaggaaagagtgagttctccatataaagacattcagttccaagt

SEQ ID NO: 373 - DNA, 215 bp, Homo sapiens
ctgcagagtggtctctgcttactcacatcgtcctcctctcttcccctcagccacaccctccagtccttcaagcccctgatccgggtccaggcctaccagaccctgaaggtgggttcctccttcatctggctcctctgagcttctcttctcttttccgtggttgtcaggtttggaatgaccaaccacaagctgtgcagccacgggagcagcactga

SEQ ID NO: 374 - DNA, 559 bp, Homo sapiens
ggcaccgagttcttgaataaacagcttgagacagttcatgctggcttcctgggctcatcccacccttttcacatcctctgctactgtggttatgaaagtgactgcggtgaccatgagcccgtcagctcttcctggggtccaagagcaactcgaacccagcaatcaagccaggttcagccctgacttgtggcgcctggccctgtaggcacttgggaaaccttttctgtggcatgaagggcactgttgagggcagactgacattccagctaacctgctcacccagaaccctgatgggcctttgcagagaaagcagaagaagatgacaggtctcctgtcctcaagggaccaagcagagtctccatgagggtgggatctgttttttcacacctggtacttacagtgagtcctgaaaaacatatttgctggttaactgacatggagcttaccatctacagtcactcaaaacacagccacggcagagacaaaagacaacacctgaggaaaaccaacgagaaggggacagaaacgtctcctggggttacagtgaccaggtgaacac

SEQ ID NO: 375 - DNA, 104 bp, Homo sapiens
cctgacccggtgaaaacttttaacccctaaacaagaatgactgctgtagcctctccggatgggatgagaatattcacatttcattctcataaaaatgctaccaa

SEQ ID NO: 376 - DNA, 19 bp, Homo sapiens
cactaccaaatgccagtct

SEQ ID NO: 377 - DNA, 62 bp, Homo sapiens
caacaataacaacaggacacagaaaatcctaaactctgccaggtatggctgtcctcacttta

SEQ ID NO: 378 - DNA, 54 bp, Homo sapiens
gggaattaagacttctggtagagaaaaaaattgaaaaatattattaacataaag

SEQ ID NO: 379 - DNA, 173 bp, Homo sapiens
tactcaggaggctgaggcaagagaattgcttgaacctgggaggcggagacaacaagagcgaaactccgtctcaaaaaaaaaaacaaaacaaaacaacacacacaaaacaaacaaacaaaaaagccaaatatatagatgagcttggaagtacctccaagtaccagaaggccata

SEQ ID NO: 380 - DNA, 398 bp, Homo sapiens
catgctatgggataaacaaatcagctctaaaggaccaaagttgagaccactgactgtgtgtgcctcaggggtctggaactgagctcctggccagagctgccgacccgaagcctttggtgaagagtctagggaaaagccagggccccgggcctgggctgcataggtgtgccaagttcccccaagactcatgcagcatggaagccctgccctgggaaccagtgaacctggtaagaacttagcagagacaaccataaaattgtcccaagaaatacctccataagtcaagacacatgcaggaccccacagaatataagctccaccaaagatgatctcacagacaacaatgacaaaacaaatagtcttacaccagttctagtggtagttcttacataacagcc

SEQ ID NO: 381 - DNA, 22 bp, Homo sapiens
tacataacagcttaatcaactg

SEQ ID NO: 382 - DNA, 147 bp, Homo sapiens
atgagccactgcacctggccaactatgtggataatgcaaattctccagttccagaaacagattttttaaaagcttggaattccaccttatcccatgttttaatacatctttaaataagtacaaatgcgttttactttcttttccaag

SEQ ID NO: 383 - DNA, 1819 bp, Homo sapiens
ttttttttaattaatgcctttttaagagttaaaatcatgtactggttaatttcactaaaaccagaaattagtggaaggcttgattaagggaggctttatttgatgttaacttaccattccatagactataaagaacattataaaaaaaccctctaaagtgacacatgccccaaatgaccaagacataagcaaaccttttaaattactcatctttcatatgtgtgtttgttcccctactattatcactgtgtcttctgtcttttgtctacctatgagaactgcacactatctgtggcaatattgtgctcccaaaagtccagaatttcccccaaagtattaatatgttgtggatataatgtgtaatatagcacatcctgtgttatcaggatattccctgtgaaagacttacaaattagcaaccttctaagattttgagttctaatgtcctaatttgtgggtaaattatctccaactcttagattgcaacatcacttgagtaactctttagcaaactctttagcaaagtatcacaattacactgcttaggctttttaatactagcattaataattcatgatgcttgtgtactgatcaccaagcaaggaccaataaaatcttggctataacaaaggaggaaaaaaagatggtgaaatgtagacatttacagacatacaaagtttaagagagttcactgggcagagagcttcttacaaaaagagccatgtagtttctctcccaaaagagatacaagttcagcctcaaggaaagttcagaactcctaggatagtcctatttatagtctggaagggacatttgagatcaaaaacgccatcctaaagttttttacttttttggacattatcctgattacccaatgagcccaagatggaaaccagaggagaggatagaggggaagccgtctggctccagggaaggcatgagtggaatttcagtccagacctctctctgaggtatgccctctttcctggcctctgcatctgcagctgacttttcaccaggaaagatctcagggcctcatcccttatcacctgctgcttgtcaaccagcacttgggagagagagggctcctccaccagtcccctgccagtcttggggtgagggggcagcgtagctctcataatgcctccctctggtagctcttctgagcttggtgagaagcgcacactcatctggggttactttccaaggagaaggtatttttaaatagaaacgagaagtaattataaagaaatgactgcctggcaacagaaatctaaatcccaagccccaagctggtgacagttgtagcatgaacatctggtgattctataattaaaacattgacacctcaccgtcgctcggctccctgcagccccacagaaaacctggtgtaactttgctcttctttacggggggaaaaaaagttattttcttccctttcttctctgttcagacataacatcatcaacatagctctttaaatatctgtgccgggaagctatatttagctactatttggccctcaaaatgagcctgatttcctgtggcaaaaagttctcagcaacaaggagagaggccaggagtgttccaggcactgacaaacagctttaaaacttgagatgcccaaatgatgtgaaaaagttaactgagtgctttttctggataggtggctcacactccaatagtagggggaaaaatcacaaaggggtgtgtgtttggtctgaacgtttccagagtcatcctggagaacagcttgacgaggggcaactctttgggcccatatgttgtacacatccctctttcacaggcaggaggggaa

SEQ ID NO: 384 - DNA, 710 bp, Homo sapiens
tttttgcactttttcttatggagcctggaggagcatgatgagtgatggtggccaaactggttctgcagagatggtctggcacctgctgtggttgagctttgaagcctctgccaaacacaaggagggcacaggaaaagtcacatttcacaccccgttgcaaaagaataggatgagttgatgtgagctaagtactatgcacaatgcctggcacccaggaaatggtatatggaaggtacagcatcttcattttactatagacagaatggatgctaaaattcatccaaatctttagttgtctctataatctgaaattccactctctgattaataaagttgtctttaagaaagtggtttttcattacggaaatgaaaattgtgactaacaaactcaagtccagcctcagtctcaggaggatccgttatgcaaaaaggaccctgccttttgcaacatacaacacacaaacccacagcgggttccagtctcaatggctcacttgtctgacaggatcttcgctcagaaagaaacaattgtcaggttcatgttgtggcctagcaagagtttggaaagttccgtaaagaaaaataatgtagacaaatttagaacctgccccaggtgtgttgatttgacgccaaaccatggataggtaacttgattcagctgaacctcgttaaaataatgttggaaaacattacattactgcaacgtcctt

SEQ ID NO: 385 - DNA, 449 bp, Homo sapiens
cattactgcaacactctaagaaatcggtaataaccatgtcattacagagaagcccaaaccttcctattctatttgacatgcactaattgaaaaaaggcactttgattgctgtaacataagcctatcatccactgaattagagtccataattattagaatctattttgatgagcacctgctttgggggatgaaatactctatatgaggcctctttctatctaatataggactctttatctttttaaatggtgatttggtggcagatgacagtcaacatgtctctgaatcatcatgagtttttagcattttacggaactggtttggagattaaaactaacatcattttgttacaacagtggtgctgtgtaataaaaaggagaagtcattcgtagagttcataaacctttttttaataatttagattttaggccgggcacagtggctcactc

SEQ ID NO: 386 - DNA, 574 bp, Homo sapiens
cataggtaagtgttgcaataaaaagaagaaatttttacatttctattttttaaggaaggcattttctgacatttatgagtaaggatattccaagaatattgtcatgtatcttgttgtttcacagctcaagctatgggaatgaaaattttaatctgagtttctaattatttccccgagacagcttgagagagggggaggtaacttcccccatctcctaggtaggtggtaggtaactaaccctgcagtgcagaaccaatgctctgaaaatgaccaggaaaaatgccccaatatctactgcttccttctaagtgggaagatgggaaaagaatattggaagaaaaaaatcaaagtgattatgagaaaatcataagggtaaaaataaaacatgagagagaggaaaagcagcagctctatattattttttaagtcttgttatggcagttggttgcttttattttcaagtgggttaacctgacattgtattcactttgactttaaatgctagaagagtacatttcagcaaaaagaaaaaaaaaaggcaatgggaaactttcattgttataaatgaaaagtt

SEQ ID NO: 387 - DNA, 654 bp, Homo sapiens
gaaaagtgaccgtaaacatctagggagctgcaggtggaaagagacaacacccaaacagataaacaagtgtctaaaaatgctggcaaccgagcaagcaaacaaaaggcatcagacttcaccttgatccattatcagatctcagagtcatctatgcaatcttcctccctgaactttctaaatatccaaagccaaattcctcccctcccacgtccctgtccctggcctcgccattcacacacaccttcttttccctgtcttgctgtgaaacttggctttcgccatgcacccagtccccaggctaaccaccacccccagtaccacattacttttgctcttctcttctggaatactgacttccaagtctaacatctgtcacgtgatacaccgcaattaaatagcctcctaaccagcccccctttctctctgttctgctacagagtgatggctcaaaaccaaatcagggcatggcattacctggctttaaaaccactcatagttctctcacctgcagaataaagaccacaccctccagcgtgacattcaagttttttctgaacctgcctcagcagcgtcacagtgatggcgatggtgagatcacacacacacatttgtacatttatagtaggacaaacttcatgaccctcaggagttact

SEQ ID NO: 388 - DNA, 1186 bp, Homo sapiens
cccagctctattacttcctggaagagagctcacatggagctagagttaagagtggttcctgctgacggcccagcacaacaaggcagaatgagtgtgtgtgtctacaggcaggagtggcttatgctacttaagaaaatcaaagaaacaagaggacatatttttaaaataacagaaatggaagcaaactgaatgaattttttaaagttgctggaaagagaagaatgaaacatgtcacaaaataaagagacaagatgatttctggtccctttttattttcagatggcttcacttgacattcagtttcactgtaagcactggaacagcacaagccagccttttattaaaaagagagagagagagagcgccatttatttccatattaactagaaacaagcaatgagtcaggtgtttaaaaaagaacatgattgccttaatatcatcaacagtgcaacctctgaatgaggatgtgggctagtaaaaataaaaataatgattgatacatttttttctatttacttatctacagggattaaaaggattagctagatgatggattggaatgttaaaactctcagaaaacatatttccctagttacagatacaaacaatgaagaacacttgtctttgtgtcaaattctaataaatgatattcaggtatattacaaagaagtcaaaacgcttatttcaatgccaaagggggagctggtgaagtaaactggttgtaacctattagagttctcctttcccatgttctgcagggaagaaaacaaatcagttcattttccaagtgcagatcatctccaaatgtcatgtgcaaaattatgcttacctgtctattaagataaaatgaatcagcagtgaaacttacattatgttaaagacagaacagcaaagacgagacaaggtataaattctgaaccgtctagctaaatattataggaggtgtccttttcactttgtaggtcctagctgaaacctgttgcaaaaagggtggtgaagagttagctgaaatcaagattccttggaaggcaatccacaatggatttgcagaatgaggtctgcaaggacaaaagtcaaattaaatcatgtccttttatcacctggctagagactggtccataccccctaccatttccttgatttggtttacactaagacatttctgggcctttgctactcctgtctc

SEQ ID NO: 389 - DNA, 236 bp, Homo sapiens
cagcctgttccatttttctgagcaccaagctcagtgagcattcaaagaatgcttgatgaaagaattactaaattaatgcataaatggagatgaaattgctggccttaaacctgcccatgtcatcccctctcttaaactgtctactcccagtttccagtatccctttgttgtaaggcaaggccatcagatgatttccaaaataactacaactccgggattctaaagcagttttcttc

SEQ ID NO: 390 - DNA, 226 bp, Homo sapiens
gactatatatcatttctctatcatttgatgttcttgtctgggctcattcatgagactacattcagctggctgcagtgcagggaccaagatggacttgtcaggagccttggatcgagctggcagctgggtaccttggtcctcttccaagcctcctttcatcctccacgcactagactagcttttttacttggacaagctccaatgcgtgagcaactatcaagcctct

SEQ ID NO: 391 - DNA, 270 bp, Homo sapiens
gacttcattgaaatcctattaattttcttgtcaccaccattgtaaatgggatcttttttctattttgcctcttcctgtcaatatttttacccttaaatgtaggcccttatctaatttaattggttagcccttccagctcaatgcttaaaaaatagttctgaacttgctgggaatgcttctgctattaaaccacttataaagttgatcattgatttaagtaaatattctttaccactgagggaaatatccctctattttatttcaccacgg

SEQ ID NO: 392 - DNA, 43 bp, Homo sapiens
ttaattagtcgttcatgttgaatgttaacaaaatagaatctta

SEQ ID NO: 393 - DNA, 230 bp, Homo sapiens
ttgattttaaattttacaaaaagaatctgttagtattttttaattaatataacgggttatatgaatagatttctcactaccgagcattcattctgttttttatacagatcctccctctccggcctcccaccctcagctgtcaagagatgactattctgcatacagactgtcaatggatttcagccttccagttccacttcttcctcttccccagctgttagcatctagtt

SEQ ID NO: 394 - DNA, 108 bp, Homo sapiens
tctattggacatcactgatctagaggaattctactctttggttgtacatattcctaagatattttgatattcctgtttaaagatagttgaccagggacgttggctaac

SEQ ID NO: 395 - DNA, 58 bp, Homo sapiens
tggagatagttgaacgtacttgtgatccatagtcagagttgtgacctggctttgttct

SEQ ID NO: 396 - DNA, 151 bp, Homo sapiens
ccctgaaccgccaagcgaagcagccaggccagccttttagaggatgagagaccataaagaaagacaggccatgctgtctcacacatttcttccagccaagcccagatcccagctgacatcagccccatgactaaccccaggcaagaccagc

SEQ ID NO: 397 - DNA, 826 bp, Homo sapiens
caggccaaccaactcaatgctctatgtctttaagatggaaatcatgctatgtgtatggtgagcactggccatcctcaatttaattagtgaaactgattgccaacttctctagagtctcttgcaattttattttaaactagacaaacctgtcactggtatgtcatttcttaccaatgtcttctcccttactttctatcttccttatcatgcagttcaaaattcacatactttatgggtttctctcaagcaacttccttctttgccaaccagtgacagataggcactcttgcctccatgaggtaacttttattgcctgcacaataagtaacttttcacaggtaatgtgactaacaggtgacacaggtcattacctctcccacgtatctttcagctgacacatcctctaaatccagcccacctcctcccaatgggatcagcgggtattccccaggcaagagagggagcacatatcttcaaattcattaaatctggtatttagagcagagttggcaaccaagcaacatcatcactagaatttactgttcatgaattactctctaatagaatcaattttctaagagatttaaaacctatttaaatcaaaacacaaataacatgtggctgggggctgataacagaacagggcgttgactggccactgtaggtttcttaaagaaggctgccaattcctaatgtgtttgctttcttttgattttctatcttccccattctacccactgcaatttgtatccttttcacagcttcattttatcattccagtttgaaatttcacattcaaatcgtccagttacatataaatattctt

SEQ ID NO: 398 - DNA, 78 bp, Homo sapiens
ttacctaagtgaaattaaaatgaaaaaattctactttcagaaatattcaattataatgtcaatgagagaaatattttt

SEQ ID NO: 399 - DNA, 255 bp, Homo sapiens
tgttgcaatgtatgttgactctttagcttatattccataggtacagaaagctagatatacctaaatattgccttctcacatcactaacaatgtcatcaatacaaatgtactgctctctgctatactcttgtaggttcccatttttattataaatttcggaaacactagatgatgagtataaggaggttgaaactcaatattacccaaatatagattaatccagctctgttagtattaacaaaaaatatcattttt

SEQ ID NO: 400 - DNA, 79 bp, Homo sapiens
tgatttttatatgttatgtattttataaaggttttctcacccatccttatggaaatcctactgagtagaaaccatttca

SEQ ID NO: 401 - DNA, 1083 bp, Homo sapiens
ttcatcttactattgaagaaaaaaggctcccagagttggtgctaattaccttcccatcatcagttcgaaagtcacttctgcctgcaccatggtacctacattaagaaagtaagacgttagagtacatgctctctaatgtccttccagcctcaacgttggcttatttgcacatactatagtaggtgtgcccagttccctatcgctgggcatttttcccaggtctctgtgacacgtaacagggtcaggaatgaaagtatacctgcccaattgttaacattatatgttgttattgatccaaatgaactgaaaaccgataaaatgcctaacccatggcatcaagctttgcaaacaaatgacaagtttggtaagtttaacaggttccgttttgaaaggcatctgcaaggtagaggtggcagagaaagctaagctgatgacaaaatggtctttctcaaaagcatatgcttagaaagtctctattttacgacattcactttactagactttaaacaattctcacatcaaccataaagcaagcaatatgcatttctgcatgtgtctatatggtgtacttttgaaatcagtatgtattaatcaatgttaataatgattaactcctctatttctcatattgtagctgtttcagtggaatttatcccatttctgtctgggtaaaacataactgagagcagcagtgagacaggataaagaactttccagtgcaggtttacagtgcgttccactcttagcaatgactggtgaaaaatcacatgtccgtcctgctactcagattatgacaatgtattactgttcagggaaggggaggctattatgccctgaaaatatggaaggagacacttgcttttatactcctttttctttcccaagtccagggcattcatcagtcaaaatggcttgttaaattaattagtttttactttctccaaaacagtaagtcctatgggatggggcaatacttctcttacgaaccaccacagttttatttgacatctgtcggctaaaattttcccttttatataatttaaactttcttttaattatttgtcattattactactattgtta

SEQ ID NO: 402 - DNA, 945 bp, Homo sapiens
taaacattgtaactgaagtttatgaactagaaatatacaatgtttccctgcgttactaggttcaacatattttggacataagttcagaataccaatagcataatattgtacacataaaattagaccattcatagagttgccttatttgcttagcgaccacaggaaagaaagggtattcagagttccaggaaaaaaataagaaaatatgtttgttaatacttctaaggatgctatgctcaccagtattaatatgataatatttaaaatgacctttggaaagaagaaataatataaagatgaaaaatcaggctgtctggtttttttctttaccagtatacagcgtatttgctgaacatattcttgaagttcaaagtcaatgccatatatgaattttgttatgactgatttgtatgttgaatttcatcattgctatttgtttccatgtaaagactgtttctatatcatgtttaaacataaaaaatacttacaaatgtggaaatataccactccattttttcctggaatatgtgcacatcatttattctgcatgtatttctgtgaatggcctgactgttattgtatcaaaatagaatttagctctgttcacataagactagagctagttacggccataaaagactagagctagttatggcacattcacaattatgggagaaaaaatgtgtgtcataggaatgtgagattttacttcaaaattagaaaaacggagacacttaactgatcatgattttttaaaataatctttttcatatgtttaaaattctagagaaatacaatgtgtaaaatctcaaacaaaataaaaatcaattgtacatcccattgttccttctagtatttttgtatacacagatattctttttaagatttaattggtttcatactgccccactactttatcatcagcttattataaagggtactcta

SEQ ID NO: 403 - DNA, 222 bp, Homo sapiens
cagatgaaacatcaacttcttttccgccacgtaaactaataaagatttgtcttaattttgtgtgaggcatgttgaaatcaaaatattttaaactcttacgtagctaaatctatcaacctttttctccatcattgccatcttggatgttttgcttagaaaaccttttcactcctgtagctttacctccacctccacttccttctaattcttttattattagtt

SEQ ID NO: 404 - DNA, 498 bp, Homo sapiens
acattaacgtggaaagggttaccatcagtgtagtactcggtttttacatttaggactttgcccagtggccatgtggttttctcaaaagataaattttgccaaaaatgaaacaaaccccttgtgaataaaaataaataaataaataacaacagaaactgaaaattatctcaaagacctcaatgaattttgtccatggcatggtaaatatgtttgccctgcagtagacaggaagggccagggttgaagagaagcaagcatggcaagacagaggcagctgctgattcctagaacagcaactcccaccccaactcccacccagcatttccctcttgtcaagggaggccactgtgactgtacgccaagaagggtttgaagccactagaagataaaacttaagcatattttttgaaatagtggcacagtatcacaggatgccttctgatttgtgtgagagggtggcaagttgattcctgttttagtggccatctaaagtcgcca

SEQ ID NO: 405 - DNA, 66 bp, Homo sapiens
ttttaaaaagcgatgtatgctacattcttctattgtgttactatgcaggaactttacaaaaattct

SEQ ID NO: 406 - DNA, 559 bp, Homo sapiens
aatgcggtgtaggaaacaatatagataagtcagtacacacatattagaaaacacgtggcagtgataaattctataaacagaacaaattagagggaagtgatactgagctaacaagagggctatttcacactcgatgtgaaaagttattgatttattttctacaatattaggcactcacagttggtaaaacagctgttggactactggccaaaaagaaaaactaatacaatattgaaggggctttgttcaattcaggctgttttaatgctatttaaaaataaagatcatagtttaagttttttcatagtctaatttttattctataactcactgaagtagatttaccataggatgattatcagtggagttcatttctcactcctattcagaattctcatagtataacattgtgaacaaaattgtcttatcgcttagcaaacacaggaaagggtgttcagagttccaggaagaaaaagagaaaatagcctttggagaaagtaaaataaagacctggcagagggaatctgaggacatcttattatggcaaagtgatctagtg

SEQ ID NO: 407 - DNA, 653 bp, Homo sapiens
atctagtggaccctctgtcctagccaaagttggtaatgtgactttccaagatgaagctgttgcaggttgcacctttgtgcgaggtggtagcagaggcctagagtgcaggcaaacaggggactcagcatcagtcccttcagaattcactgctgggggctcactattcatttcaaaagctgcagcatagtgaacagattcttgcattactaccgggcccttcttcagaaaagaaatctgtggtagaacctgggtatccacttacacagccaggtcctaatgtcagcaatcattcattcattcctaccacagagtgactcatgctttatttctccctcagacttcagatgaactcagaaggccagggaacagaggtcagctctatccccagatgctatgcttaacacagtcacttctttctctattgtcgcagaaagtgagccccacaggcctacgcttatttgtcgtaaatatctggagctatcccatactcgtatgggatagattgttttctatgctaaggaaaaagaaacattcaaacaaatcaacctgcttactgagatgtatgtcacaatctgttttggccagacggtcatttgttggaaaattcagtaggtactatgtggaagaactcagggcagaaagacataatattg

SEQ ID NO: 408 - DNA, 291 bp, Homo sapiens
atgcagggctgggtgggactgggaatggtcttgtaaagggttgatgcaggccagctgtgaggttcgtgtggctaataaaaagggagccacaaagcccggtgtaggagaccagttagcagcttaaggagaaagatgggagaatggcctgtactgggaagaggcagtagagaagaaagagacatggaaggacgaaagacagatttaggaggtagaacccccaggatgcccttcctccccacaggtaaataacacctgggcttcactcattccacagagatctaagcaaaaacg

SEQ ID NO: 409 - DNA, 399 bp, Homo sapiens
tatgggtttgtttgcttgtttttggtgggtgaggcatctatttagaaatcattttttgttgggccccttaattttcataaaataatgcaaagacatgtgtactttaattagcaccattgagcttctgatttcagtttcttgccccagagtccaccatgcacactttctcctactatgcctcatgagggctcttttacttgaaacacccaatctttaaggtgggaaaatgcaccaagcctgataagtgactctacttcctggttccagacccagtgattgttccattcggtatggaccagattatatttcatgctggtccagattatattccattagtgaattttctaaatttcagttttctaagttcaataccaatatttatccatttggccttcgtaa

SEQ ID NO: 410 - DNA, 39 bp, Homo sapiens
ttttaaaaaataagaacaccaccctgtccttgggagaaa

SEQ ID NO: 411 - DNA, 227 bp, Homo sapiens
aaatctgaagtagagaattttttttcttcttgccttatgagctctgcctagaattcatgcctagaatggtacttggtatatgctaagtgtctcttctcattcttgttatcaggggatgcattcagagctgccagtggccctgggtcccgtccacacgaagaagctggaaagaatgaggccatgccaaaacagaggctgagatgagaggcgaaggcagaaatctgccc

SEQ ID NO: 412 - DNA, 480 bp, Homo sapiens
ataaagttcatgctgttatttggcagatgctgagatgtgagcaagagaaaagagtcaagaatcaagcaggaatatcgagcaaggtggactcagtgactcatagaaaacacacggagacaggttttggagatgatgatgataataatgatgaacttagttttgggcaaaatgagtttgaggatctttgaattttcccatgtggagctgttccatttgttgtttggaaacgtggatagaaaactcagcagagagttcagggatgaagctgtagatctgggagccaactgaacggagctgcagctgaaggccatgacactgcaagaggaacagagtggggctagaaggagaccaaggactgggcaaggaacagaagcaggcgacacggccttgtgggagcacgacaaggagaatcggcatgtgtaaggtgagaggagtcacaaggggtagttctaatgacacatagagtgttgttgtgctctt

SEQ ID NO: 413 - DNA, 653 bp, Homo sapiens
gtgtcgtggcactctggatgcagacactggaatggatgagagttttgaagaggcattgcatttctctggatgcagacactggaatggatgagagttttgaagaggcattgcatttctctggatgcagacactggaatggatgagagttttgaagaggcattgcattttacaagtagtttactggcaccccctgagagaagatttcagtttagcaggagcaaatcccagactgcacaaggctgagaaggatgggagatgagaagggggaggggaggcacaaaaaagagggaaaggtgtgggaattccagagttgtggtgaaatcagatcgcctcttgtttttcttaagaataattgtgatgtaaacacatttgcatgttgaagagaagtcaaaagacaaaaaaaatacatcagacgagtaattattgacaaaacaagttaaaagaggaagtgataaaggaaaaaggaagtagcttcaaggaggggaaaatatatttccttatttaagacaagagaggctacacatatctgagaggtgttaaaagatgaaaaaaaagacaaaagggcaagagaaaatgaccatgatgaaccagagaaaatttaatgtagaagagtcaatgttagctgaaattccatccaatgatctccatctcat

SEQ ID NO: 414 - DNA, 822 bp, Homo sapiens
ttatttttaagaaaggattttgatctcaggaaggtaggtgacaaagtcatgggctgcctgacagagggctaaggtgctgagtagaaaatatttggaactgttgtgagaaattaagtttattataactttggagaagccctgaagttagaaagcatgaattggtagtagatccagctgattttttaacagcccaagataagaaatggcaaaaagcacagtcgtgtttttccagtctgatgggaagtcaaggaacaaagcaatctagggtactggtgagtgttactgagttaagggagcacacttgtctcatttctcagcctgacataggtgacttgtctggtgctctgcagatgctgagtagcacagtatctggcacagaagggtcaggcaataaagatttatttcactggattaaaaaaaggcattctttaatttttatgatggactctttcatccacattcagctctgacacgtaggagtcacttttctttctttcctacatttgttctgtcgatctgatttaaaaaaaaacaagatgttttcggaatcatccctgtggagagataaggtggtgatggcaatgggaaaatgcaaagtagaaattagaaacaaatacatgaatatatttgcagtagcatttgaggaactgggaacgtttagtgactgtgtgtgtgagtgtgtgtgtgtgtgtgtgttttcttctaagcacaagtgctgatgttctgagatgaggtagtgcatcatgaatcatacacagaaaggatttatgaaccaaaaaaaaaaaagaatgagatggtgggcgaggaaatctggggagaata

SEQ ID NO: 415 - DNA, 57 bp, Homo sapiens
ttacgtgcagccaagattgacaacccttgagcagagctcaggagacacagcctaggt

SEQ ID NO: 416 - DNA, 298 bp, Homo sapiens
aatgatttttcaccttaacgtgtgaggagaaacatggccaataatactcaatattcattgctgcataaatagagtcttttcagaactcctggagacttcgtggaaaatggcaccctgggaaacactctgtgaattaacatttgttttatattggcagactgaagattgttaactccacaaactgtacatatttctaaattgggctcttggaggacttctaaaccttccaagtaattgatctgaagctaagggcataagcttagcctttatgacaacatcttgtactattctactgccc

SEQ ID NO: 417 - DNA, 241 bp, Homo sapiens
aaaaatatagtactttcattaggacctgaaagagttgatcctaagtctactgaccagctttcttgcagtataatccacagaaaacttcaagaataactgattctgttttcctatccttgccccttgatcccccagctgaggaagcactggtgagaatcaccccctctcactgatgttaagtatcaggtgaaacctttatgcgtttcaaaggctgaagaaaacataaaacaaaggcggcctt

SEQ ID NO: 418 - DNA, 487 bp, Homo sapiens
aaaaggcggccttattagcctgctttggtgctgatctgaattaaaagctgaataaatgcataaacataacaagaacactagacaaaatccaacagaaaagagacatacatgtcagaaacatagttatctctagtgtgcaaatttgcgtggcatcctaagggtctggaatgaatggaggctcctcttcagtcttccttagcatgagccaaagaattcaacttcattgaatcaacagtggtactggtgggtgaatatgtaggggtaacaagtgtattcgaaacttctctaggatacggaatttgcacagaaccgttgaagaagtagtggcaggaataaaacagaaacactaaacacaggaaaagaggtaggtccccagtatttggagttgatggctactgttttatgttgcgggattctaacaaacattatgaattacttacagatccattcaaattcttgttctgaaccagtgggactcaagcttggc

SEQ ID NO: 419 - DNA, 39 bp, Homo sapiens
tcaggtacagccaagattgacagccatggaacagagcta

SEQ ID NO: 420 - DNA, 225 bp, Homo sapiens
agccgaggtgtaccatgttaccatgtgctgagacaaggaaaccatccagcattccttgtggccctctcaaatcagcgacagagctccctggatgctcttttgcgtgtgcttgaagggcaagttgtgcattttatttgctcaagtcactgaagcctggtgaagtgggacagcctcttcttttccagtctcaaaatataggggcttcagtctttgctgttcttgttt

SEQ ID NO: 421 - DNA, 295 bp, Homo sapiens
ttctagaagccatctaatttcccctgtggtgtcagataatcccaaagaacatggtgtcctgggcatacatgagccagctgcctggagtccctcctacctactggcactccatctatggagggaagccttctctctgtcctctgccccattctgatctgcggcctcactctgcgctctgaatctggcctaatccaataagcaggacccacagggcattgggaatcctgccccagataaggaccatcatgcacagagaactgtagtggccaaggtaatattaatagtcataagtcat

SEQ ID NO: 422 - DNA, 1042 bp, Homo sapiens
gggctacgggtgggatggcactgggggcaagaacgctggacgccggctgttaaatggtgtggtgtccactcctagatgcagctgatggatggcggccctgggcaggttgctggcctgaccccaccctgggtgcctgtcctcagatccttatctacagaaagatgggctttgtctagatcactgcagccctttcttgctctgcttttctagaagtctctctgtgactcatgcagctgtgcctcctttcccaggactctgccctgcctggtgatgacacagcacgttcagcacatttgtttccagggagagcactctccagaaggaaccagggccagctcctgtggcgccacttggtcaggctagctggaggttgtgtcaacgtctcggagagccccttgattacagtttataagccggttgtaaagtgcccattctcgggcgaaacttggctttcagttctctgagatggcagagcattgcgaactggtcactttgaaagctgagggagaggtggacggaaatcaggtccgctccaggtggcagccccgcccttgcttgtcagtcccagagcagctgctgtggggtgtgccctcccaggaggggatggggcaatgctgcgagcttgcaccaagctgggagcagttctctgtagctctctcttctcctagggccagtaggagtgggtgtgctgatgggggctcttcttacagatttttgttatgatagctactaatatcatgagttgttgctactgacaatacataggatgatgtgttactttcctctatgacgactgcatttgaccttgaattaggaaacttacattggagctggccctttcattcgaatgggcctcattcctcatctattacatgggaagaaggagtgaaataaaccccttttcttatcctctgtgaaaattctacaccaaacacaagagcaatcacacaaattgagaaacatgggggcacagagagttacctgaacaatataaagattttagttgctgcagtgatttattttcatacatttattttattta

SEQ ID NO: 423 - DNA, 101 bp, Homo sapiens
aatacaaatattttagcagcgttggcatagcactaaaaataacatctcaaaaatcaatagtgttttgaattgataaacctcctttggaggaatttaaggca

SEQ ID NO: 424 - DNA, 588 bp, Homo sapiens
agaataagagagtggtcagttgagacagagagaaagaaggaaaaagaggagaaaatgcaattttgcccaatttgcaaatgacccagagaggctcagagaggcttaatgaaacatcatgggtctcacaggtatcgcatggatgatgatcttagaacctggatgtttggttattagttcaatttttagttttccaggctacactatgatgtcactgggtgattacagcttcaaccagagaggggaggatatatttttaatgttacaggacagccatgcctgtaacattaaaaaggggctctccatgcctttcaagagggtttttcttcgtggacacattgttgggatgggtgtgtcagtctgggagtggggactgggaagaaaaggcaagttctggcagaggccagagtggggtagattattctcccaggttctgtcggtttctgggcagctgctaataggaggatttgggttgtaagacctgactcggttgtaaggccgagagtaaagctctcacctgtgcaaaagctttcattgcctgggaattaaagtttcatggctccagcctgtgtgcgtgtgtgtgtgtctcta

SEQ ID NO: 425 - DNA, 78 bp, Homo sapiens
tcagatataaaagaaaaaagtgtgatttttcctggctgtgaatgagggatcagttgaagaaattagaaactaaagttg

SEQ ID NO: 426 - DNA, 81 bp, Homo sapiens
ttggtgagtctttaaagaactaattttctttggtggagaagacaacaacaacaaattgtgttcatttaaaactgtgtttca

SEQ ID NO: 427 - DNA, 453 bp, Homo sapiens
tgtatttcaattggacttagtctttttgttactggaaaattgtacaatacatttctgggagcaagaacatgttactgctcctggtgcaaggtttgaattactaagatccaggaacaaagatgtatgtaaactttgattaaaagacagaaatgaacctgagaaacagtctggcaattagaaccaagccagcagggtactgttatttagcctggaacatcctttccaagtaagtggggagaagggcgctgcttcttagtgaaaggagtatataattaattggtctggtggtctccactcaaccagtgatatgtgtaattggtttctcactgagaacaaaggaaagcacacaataaatgctagctttgttgttgttgttattagctctgcagctggctaagctctggtgaacccacaagaagaccaagaaagagtagctgacttcaaatctccttc

SEQ ID NO: 428 - DNA, 723 bp, Homo sapiens
atgttgagcaactgaagtgaaggttcacactccccagaggttctttatgaaatgattgctgaatggaatggagtcactggcaaaatgtactgcctgggggagaggggcacagatggtcaggcatcctcagaagaaaggaggaaggtggaatgaataatggcaagaagaaaagtgatgaaacaataaatgagagtagttggatgataaaagagtacaaaaaagtggaaaggttaagaaaaatcttctattaaacctccgaagaggaattacaaagcacccagagttaagccaaatgatcagcagacaggcctttccagttgatgttttcatttttaatttttttctgtgacatcagaaattcctgctaacctttccactttaaagctggagataacatggcctgaatcaggcaaaaatcctcaacagaactaggatgatgccatctaggcggcacagtctctaagactagaagccatcattctctttgtatcagatccagcctggtcccactgcctgctgaagctgcacccccagaagagacagagcccctggatgtctccaaggggcaacaaccagcccatcctctgtcctgtgcctgtaaactcattcatctccatctcaagtgttcgccatgatcccaggttccaggaggccgggaggatcaagagtctcagagagcagaaagcccacagaatctggctaccaccgggagatcagttgccc

SEQ ID NO: 429 - DNA, 137 bp, Homo sapiens
gagaccagttgcctcaattgtcagtttcctcctctctccccttctcaggtctatcatggcagaatttgtcccagaacataaaactacagaacaccccagtttcggtgtgagaaaagagcctaggcatctcctaattt

SEQ ID NO: 430 - DNA, 1626 bp, Homo sapiens
tacctaattcagcctgatctgctaatctcctctgtaactccccaccaagaggaaattcaaccttttcatgaacacttggagggacacccaatccatttttggaaacatctaggcgtttcttgattaccatgctctggatggccaaatcggggggttttcatgcagtatcacacctggacttcgagccacaagtgaacacttctctgggcgcctcacttctggctctccctggatctcactgcaacctgagtgccagagctgtgaagactgcagcaaagtcctccaactgccacggtaaatattatcattgcctctggtatgcagaaaagcaagccgagccgcatttgctgcttccaggtggcagacacagaaatgagagcagggagggaggggctgggaaggtgtctgggaagaaagagatcaataagacctcactagtgtgcagtatttactgtaaacagcccaaggtggtttggggttggggtgaactgtcaacatagaacagttctttctcagggactgtgggagcaggtgttctaaaaggaaggatgaagatagcagttgcagtgggatgggcaatgagaccctgggctcagggaagtcactgagggttaatgtggccgggcagccaacgtcacagcacacgaggcccctgccacatcttacccacacatttcaagatcctgtatcgccacagtgtgtcattactttgagaccatggactactttctcaattcttcagcagagaggttttttccaaagcacacaaatgctagtggtggagctggtttaaggccaagaatcctcaactgacaaagagctcagtaagccctgggtaggataaaaaatgcaggtgtgtcttgccctaaaacatctcaggatgaaagaactcgttggaagtgcctctccatccagattttgtctaaagcgtttaaaggcggctctctttcaacaattaagctggtgtgggatggaagagctttcctgcagttagggaaaaaccttctccctcttcctctttcccagttccagttgcttttgagtgacaggctaacctgagccctgaagccagattcagaattactatggctttgaatttgatctcttattgttctatactgaaagagcaatattctttttgaggtgagtgagttccccatattggaagctgctctgggtttggggtagaatcttcaggatccaagggaagaggactgaactcaaaggaaaaacaacttgggttgtagttggtggtgagactacgctaactttgtttttttttgtttgtttgttttgctcgccaagaaagcctctcctaattcaccagttccagaaggctgcctgcttccctggccacaggggtaggtatgtattcaggtgtgaccaatcattctgtcctgacgttagtgattgacccaagggtcaaactgggtcttgccaaggtccgataaatataaagtaaatatccatggttgctccataggaggctgtgaatttggggctcttgggcaccgtgttattacctgacatggggagacttggaatgaggccgacagacaggtggcagggatgaaagataaatgcaggcgggcatgaagctgcatgacagggagagtcctgggagtg

SEQ ID NO: 431 - DNA, 753 bp, Homo sapiens
tgatgtcataattttcatcaccgtgtagctgaaacctgaaacgctcagctgaaacactgaatggcccctgaaacctagtgactacaatcagttgcaatcctggcattccgggtgctggtcccagctgttctttcctttattctgctggtttcaacagcggccttcccagctaccagagcctattaattcccacttttgcacaggctaacttgacttgtgttggagtactgccatttttaaacctggaaatttggaggcggatctgtaaaatgtctaaagatgaaatacattggtttccccccccccgcccaagcttttgatattggttcaaactatgggctttcaagatgccaatagctgaacccaacacaaatgtagagcttattcatagttttcatatcattgtctcttgttaaattgtacattcttaaatttttttgctacattcttaagcctgagttttggtatctcttagggtcagcattctcctgtgggaatttatctctgaaatcaaacctaattaagagagtacatggggttcaatttagataactgcttacagtcaactttttcagatgggtaactcataaaatgaggagtacggtggtgttaacactccatttccttatcatcggggtagtgtagggctgaagtggaatgaccgacaaggaaacatctggaatcagctattttgtggcagtaattacatatcctcacccacttctgcatggaagcttcctctaggctgcaggc

SEQ ID NO: 432 - DNA, 21 bp, Homo sapiens
gagaacaacagcaggtagtcc

SEQ ID NO: 433 - DNA, 52 bp, Homo sapiens
tcacaatttgctttttatttaaaacatgaaatgtacataatcaattttatta

SEQ ID NO: 434 - DNA, 56 bp, Homo sapiens
accaaggtgtagaatctgctgttatctctctcagagtaatcatggttgttggtttc

SEQ ID NO: 435 - DNA, 138 bp, Homo sapiens
ttgtttgtttgtttgctttcattggtgggtgaggtgtaatctcatgttcttgcatagtttctgtttacttcaagttgcttttttgtttgtctcttctggaatccgcctcagatgttctgtgatctttggctgtttgct

SEQ ID NO: 436 - DNA, 43 bp, Homo sapiens
aacgtttcctcaggaaactccagcatcggtatcactaacatgc

SEQ ID NO: 437 - DNA, 1020 bp, Homo sapiens
tggaggaatcagagcgccccatcaccacttttattaaaatgatagaaaatcgactgtctgcctgctagagagtgtgtataagcacctccacaagcctgcttcacttgcttctcacagccgttttagataggtcaggaggccttcatatgcccacgggaataatagggcgcttagccgagaccacgtcgcaggtctcttgacatctaacccagtgccatttccacgtgttcagatgctatcctgggctattccgaggacaacacttgaaacgggaaagaatgatgtgcctgggcccaccagagattatgggaaaccttgatgctgtttatcaccttgattcaaatttcatgttcacagcctgagtctacaaagaagagaaacagaagagggaagcctggtgtaaaactctttcattccattcttgtctgtctttatctgctccaactgtgagggctgcttaccctagaagcagatcaatgcagagatggacacatttgcagcacctacaaagggtgagaaaagacaggggattcccaggcaccggaagaatgaggaaaacagtgacctttgttcccaggctacagaaaaatgctgtatctaaactgacatcggccggctggatggcatttagaagccaaatgaactgctgttaagcggcgaggtcaggggttcagctaattgtggaaccacgggcactccccacagacccagaaatctttgtaatctatggcttagggacatacattgtgaaggtgatttttacagttcatctttgaaaatagaaagacgcgggaagctctggctgctacacatactgatagtagccttgcctggtgtcttagaaacatctgtgaaatatagctttctggcttaaataataaaaggagatagaaagataaaaagaaattacaacaaatacagtgaatgaaccagccttgataaggtacctgcagaaaacgaccttattttctctctccaatgcattagaatccatgttgtaattttgtacattctgcaacg

SEQ ID NO: 438 - DNA, 693 bp, Homo sapiens
tgagacatggggtgtagagatgaccagttctacatctctcccttccgggaccttttggattgtgaatctcttgatgcaggcagtgccgtgttctgggcaagcagctttatgaagattcctccctccatcctggggcttctgtgtgtcggtccctctgttgggtcatggtgccttccaggaagccatctgtgctggcagggtcctccatggcttctcatgtggttcataagagactcttctctatccatagcagtcccacccctctctcactcggttcttctaggtcaggccagtggtcacagtctctgctgttagttttccccagaaataagtcaggtgccaatgtctgcactctgcacagttttaggggatgcaaatcaagttaaaagtggctaccctgctcccctgtgttcccagcagcactgtacatagcctgatgggaagggaaaaggggaaaaggtcccctctcctcctttgtggggatgggaggaaactcatcctgctgactttgcacaagctatacccctgtttgggcctcctcagtgtcccctgctgtacatgtaggcaggtgacggcatttgactctttttttttttttaatttacccctttgatgcattttgagtctggcattagcctggctcctggtggtttgtccctggcctttgggagccatagtagaatggaaaacatt

SEQ ID NO: 439 - DNA, 77 bp, Homo sapiens
taatactgagctttctcagctatctactgctaaagaaaataatgagctctttcaggtgtttctccagggctgcccca

SEQ ID NO: 440 - DNA, 50 bp, Homo sapiens
gaagaatcttagccaacagtagggtggaaagaattccattttaaatcctg

SEQ ID NO: 441 - DNA, 92 bp, Homo sapiens
ttaaatcctgtttataaaagaaacaattttaaaaattatttcaatgcttctgaaaagagctggttatctgtcttgcgtgttattttttaaaa

SEQ ID NO: 442 - DNA, 234 bp, Homo sapiens
ctaagtgttgatatgcttgaggggcatgatttgattggtggtatctctgcatttgttattttctctgtctgagtaacagtggggcctcattgtaggtccttagtaacttattggcctaagtctttcattgacattatctctgtagacagaaccttcttgcaagtcctattctcacgcagcattcttgatcagttacgcttgaaatgacactatcgatgtgtttgtttctttcct

SEQ ID NO: 443 - DNA, 101 bp, Homo sapiens
ccccagggaaactcccagagacagcatggaacaacttgccttgtgcactccttgcagaaagaggaggattcccctgttattgataagagataagagatgtg

SEQ ID NO: 444 - DNA, 273 bp, Homo sapiens
ttaaaaaaaaaaaaaaaaagagatgtgattgacacctccgatgctgagctggctcccggttctggcatcctgactgttgacacacagaaacttaaaggtgtactagaacttgaggttttgtaatccgaaccctagagtttgcaagtgaggcccctgaaacctatggagctcgttggttgaggagcgcagtgagcgcagggtcacttccagaatcatgctggccgcctttggccacttggtcacactcttcctctctctatgctcgtttctcca

SEQ ID NO: 445 - DNA, 185 bp, Homo sapiens
tcatttcttcatctctaaaaaggagaagaaggcagggccaggaaacttctctgtttgctcatccaacaaacagttgttaaggaagcgaccccttgccagacctctgactaggtgccagagttaggaacacaaatctaacagttcctttccgatggaacccagtctgatgagccacatacttccct

SEQ ID NO: 446 - DNA, 138 bp, Homo sapiens
atactggggaaggcaggtagaggcagggtaacttggtgccccataaacttggtaccttctacttccctggctattcctagggtctcaggaactctaagactcagtggtgtctcagctgcaaaaatgcaaagtagagcc

SEQ ID NO: 447 - DNA, 1263 bp, Homo sapiens
cagtccacgtgttcatgaactgcccttcagctctctccaatccagcatagctgtccacattcttcaatcagcgtggatgacagcaatggaacagacttgaaagtttaggaaaattccacttgacttgaaagcaccttgatgacagatcatacgatgcttgccttctaatggtcaggactgaacttcaagaagctctggacactgactgaggccaagcccagtcaaggggaacagaagggaagccatctgggacttcatctcagtctgccaggaaactgacatctttttgcaagttaacaaccagggaatcagagggaaattacttttatcagagggttatggctttgccactagaaagggaggctttcctgtttgccgagcctttagcacaggtccagcaataacatgaaggagaaaggctgggaataacccaaagcaaactggagagaagcttcaacttggagatggggtgggagttggaggagagactggaaaggaacaggaagagaggcagttttggaccaagtgtcagagatggaaggggaggaaaggaagaaggctgaacggtcttctcactaaggacagttcatcatcctgtagactcattgctcagggacctggggcctgcattccgaacagtggcgaacagatgtagcctggagggcctgcggatgaccctgggaaagatgcagctggtggtggaggatgcccgcgaggcagtgaccacctgagctctggcacccgcgctccccacctggcctgtgtgcatttactcagcccaccgatagcatctgcaaaagctccaggggctccagatcaagttcccaaggaaggctgacatcagacccaagggaggaatgcttccttcccgttcccattcgaaccaacaatgcagcctgtggcaggtgtccctgcgtcacagaaaccacaaggacagtgagaccaggctgagtgctcctggcccttgcccgggtgcccttgcattcgtatgttctacaccaaacctgtgagcccagccagtgggaggaggaggagaaggaaggtgagcggattggctctaactttccaccctgctggaaaagaatccaatcccttctggacgaatgccactttcacagataaaggaagaatgtggaaatagcagtcagagctgaaccaacaagaaggaaggtcggcccaacgtgtattggatgtctacaacataccagatattggatctgacaatttacgttcactctagtttattctcaaagatgagacctg

SEQ ID NO: 448 - DNA, 437 bp, Homo sapiens
tgatgagagtagaacccaaatactacctgccgactggtgttggaagctgcttaaggatacagatgtctgcttctagctctggaaaaactgatttagaagttctgaggtgaggctgagaaatacgcctcagcaaatatttctaaagccctcctggtaatttgggtccttagctggatcaggcaccagattgtcacacggcaccagcccctcccaccgacacctctgaccctggtgaaagcagcatcagtgcttgtaagaaggcccgagacctgagattccacccaccagatctgccttgacccactgcagttcccttcatcctggaccccggtctccttcatcagaaggacattggaactacccagtctatctgctttctactgggttgtatagctccctgcagatgggatctggcctccctacaaactccatcagat

SEQ ID NO: 449 - DNA, 19 bp, Homo sapiens
gcactgtgttttacataca

SEQ ID NO: 450 - DNA, 69 bp, Homo sapiens
tcaagaactcagaatgagttccagaatcctgaataagttgtaaaaaaatttattaacagattccaaaaa

SEQ ID NO: 451 - DNA, 127 bp, Homo sapiens
tgtatgaggctgaaagttaaccctataatcatgttgcccttgagtgatttcaaaccgtggactgcacagctgaccatgaccagagcctacccatcaaggtgacactgatgtaattaaaaaggaaaga

SEQ ID NO: 452 - DNA, 133 bp, Homo sapiens
aacacaatacttttgtatagttttaggcacttctagatattcattaggcctgttgcctatgtcctcttaactttgagtttctcaaactgttctaggagccctgatttcagaatcatctggtgtaatacaactt

SEQ ID NO: 453 - DNA, 257 bp, Homo sapiens
tttcggatttagaaagcactgcctaaaattcaatgccatattgaatcaaaattacacatcaaaaataatatttctttttgaaattagtagcattcagagctcttcagacttttctttttaaggtcacagttttgttttcttaataggttggggggaggaaattggtcaaataaaaattatcggaaattcaattaaaaagtagaaagagtattttttttttaaagacttgcttcaagatttctataataccaaaaact

SEQ ID NO: 454 - DNA, 628 bp, Homo sapiens
gatttctgtaataccgaaagttaaagaaactttggcttactcaaagatttgatttctctctgaagggtgggttcttacctagctcaaactcataaaactcttgtccaatgaagaaacaggaggttgttatcccttctctgtttatcaacttctccaagatctgacttttcaagaaaaaaaattacaggttcagttgagaacaatggagaaactaggttagcccattaatgttgcttttagaaatctgagcacttaaaaataatgactaactggaagattgttacagcagtgtgcatttgtcaaaatccacttagctacttgtgatttgtgtactgccatgttaataaattatagtttgatatgaaatacacagaaaaagtttttaaaaatgagtcagtgcttttgcgtaattctactcctcacattctatttttttctgagttatcacagaagacaaggtctgtgtgtgcactaactttttttctgattttgttctcacttgtttagtcctgtgcagaagtcaaaggagacatggccagagggctgctgaaatattcaccagcttaatgttacctctgggaagaagggatgggcatggacttgctatgccttctgctgtgtttctctg

SEQ ID NO: 455 - DNA, 501 bp, Homo sapiens
ggaatgcactatgatggtttcaaagaaacagttgtgcaccacatcaaaggccctcactgtgaaaccagctaccatccaaggttccagtcatctcagtggtaacggagcctgagcaaagggcaatatgggcctctaagattttgtctgggcagcagtccaccgatctcatcttcctctattatattacctcatcatttgggagtttggaagatgaatgggtgaaggaatgcatctcagtggtaatggagcctcagcaaagggcaatatggtcctttaagattttctgtctgggcagcagtccaccagtttcatcttcctctactatactagctcatcatccaggagtttggaagatgaaggggagaaggaatgctttgcaatcatctgcgattggaaactgagcccagacactccgaactaccgtcctggctggagctgtctctttcacagacatctttctttagcaatagttgctttggggattacaaaaaggaacgggat

SEQ ID NO: 456 - DNA, 1272 bp, Homo sapiens
taattttctgaaactagaagaaaaaaagggacaggttgcttttcatgtacaaaaggacccctggctagcttgctcatgggataagaagttgatgcttatttgtctacccttccttaacctgcttcccctgggaggaaccacacacagtgggaggtaccaatcaggactcaccgaactctgtgagttttgtaatggggaaacacacaccccaaccagctgctcctgatctgaatgcttttcttgggctaagtgatttgttctgtgacgttctgggctacgtcgtgtaataagtattgccagatggcaatcacaagcatcatttccatttcatatttgtgttgccccatatctctgtcactttgtgctcccagagtgggtgaagaggctgggccctctgatagtcacagacatagccaggctttaaaaatctcacaccaatcaccgtaaataattttaaggcttcttatcctttaagatctgatatctggaaagtgtgagatttttttttccacgaggactattcatacgcttgttttcttgaggacggtgaccccctttcaaactcacctggatgatgcatttcaaattctcagagaagttgcatgagccgatagctttgagggaattaaaaaagactcaaatcaaagtcgataattagcagttatgcccgtggatgtcaaaacacctgagaggctctcagttggcttggaatgtccaagtagaaatcaacttcaaacagtgtccttagcaaatttgtaaaatgtgtatacgtgtgactatgtgctttttttttttttttcctgcttgtcactgtgctgcaaattggttggaccctaagtcaatcagttaaaaagtaggcagttaggagaaaaatgcctttctgccagcagtgtggaaccaccccttagctttaagaaccctgctcgggaggagatcaaactgcccctggatgagctgactgtgagaaagcgaacctgccgagtgcacaggccagggctcatccaaaagttttgcttggcagttctgcccagaactatctctgtgtagctactcccttctgagaaatgcaaatgtcatgcaggccctcatcaagaaaaatcaccagcactcgccttaagaaagaagggataaatgctcatattatccattcaaatgtgagtgtattcaatgaccacacatgggactgagctagatggtatacacaatgaataccaaagctgaatttcgaggcaggtgcctataatcccagtgcctgtaatctttgtaatccgg

SEQ ID NO: 457 - DNA, 72 bp, Homo sapiens
aaagcagaaattttaccctccagggacttatagtctaatatttctcatagaagcaaattatgaacatacagt

SEQ ID NO: 458 - DNA, 248 bp, Homo sapiens
aagtattatattctttattcttctgagattagacatcaaatgctgaggggaaatatgtagatgaagaaaaacagttgttgagaatgtggaaacgtgcatctggcactgtcgtgatattagagagctctagacgctggttttctgcctaaaaagtgagaaggataattaggcggcctttaagtcactccttcagctacgggcactctgcaattctactgcctctaattccctacactgctaacaattca

SEQ ID NO: 459 - DNA, 380 bp, Homo sapiens
acaataaaccagcagttacacacatcatcacactgttgtggtttataagataaatgtcggctttccccaatgaattatcactattgctctcatgaaaaggcattccttatgtacttcgttgcacataaggctgtaaaagaaaaccctaccaaatacttgatcctgtgaacttatttaagaagcagttgtaatcttggccatgttcaaaaaagctgttgcgacggtgactgttttcttgacacatctacatatcaggccaatgaaagaagctgctacccagagtttaagacaactgtgtttagctacttagtattaaccacttggcgcatgcaaatgactcccaccctcactccctctacccatgcaaatgccaaaaaaga

SEQ ID NO: 460 - DNA, 195 bp, Homo sapiens
aggggtcatgggctcttttttcattggccgtgagaaatgaaccttaggtgaagaatagactcatgtaagaataagtaaaaggaaacatttaactaaaagcaagtgttcagagacaatataatacattatcttagaagacaatgaaatctctttgtttagccctcttaacagggtacatgcaggttttttttaaat

SEQ ID NO: 461 - DNA, 464 bp, Homo sapiens
acagtacattagaaacctcctttttaggtgtccccagattttacctctctttctcctgaatgtgaaagggctcacagtatagaaagtgagcatgaacaactccaaggatcagaagagaatgttgaccagaaaaacactttgcaaggacctgtcagatattccctcctgcacagaaagggagctggctgcttcctcagaatggtctgtctgcccacatgaaatcgagtaccacctaccaaaagtaaccaaagttatgccccaaatttaccatattgaggagctttgctgagttagatcatggattatatatttagcaatgatattggcaaaatgtctttttaaacaaatcaaaaattttcagggactttgagggtttcatagtaataataacaataccaacattaataacaacatctaatgtttaatgacatttacttgcaccaggtactctttctaaggacttc

SEQ ID NO: 462 - DNA, 310 bp, Homo sapiens
cttgtctaatgactagaaggtacagccttccaaatagcacaaggcctgggtggctggaaccagcctcatccacactgatgctgttgtgtgcacaacatggttctatgtgctacaaggtggggcactaaacagggcgagggaaggacaagacagaatccctcctctgaaacatgaacaatgtcacaggatacctgggagaacatttaactcacattcccaaatattgcatgagtaaatgttaaaaagcaagcaaggaccaacgttttccatcactggggtccaagactcccaaagaacactcaagtttaat

SEQ ID NO: 463 - DNA, 230 bp, Homo sapiens
tattcatttgtaacggttactgaattcaggtgatcatgatggtttgttttttcaactcccaagcgttaaaggtatagcacaaagttatacataaagtttttgttactggaacaaaagttgggaaccatgggcttggtcagtgagttcttcctggtgtgcagaaaagcaagaagtcagtatggttgaagtggttaagaataatttgtagttgggcacagtggctcacgcct

SEQ ID NO: 464 - DNA, 41 bp, Homo sapiens
tacttcatagacgaggtgcaaattgagcagagatttgttat

SEQ ID NO: 465 - DNA, 124 bp, Homo sapiens
gttatgaaaactgagtagttcacctgatcattcaggattcacagatacttctggtccagctaaagtagtgcagttgcttggctgtatttcataaagagcaacattctgggctgcattgtatggg

SEQ ID NO: 466 - DNA, 677 bp, Homo sapiens
ccttagaacatctctcactgcttgaaatactgtcttctacccactcgtaaggataaggaaggagcaactatttccatgggaagcgaaattccacagtgggaagagcacaagatctaatctggttctaagattagaacagcattaacagaacaaagatttttgtgtgtatgttgtggtgatcatttgaaacatgcacatacagtgatcatattgttcaaagcaaatttcattacccacagtcccagccacgggttgcttttttagaaccttctttgtttcagtcttgctgagttattcagactgttaaaaagctgagtgcattaagagccctaaatcaagtcatctgtctagaatatttcctttgaggaaagttccttttttcattctttctctccaccactcttccccccaccctttgttaatgaaaaaacttcaaagggtaaattgctttacgtttcctctaatggttattggaaagaagaggcagctttttgaaatacatgtctctctgcgaatgccagaaaaaaaaatgtgcagttgttatcggctcctgccatcaacattctttaatttgaagaaggattcagctgtatgaattaggttgcaggctccagggttgtgtttctcatgggtggtatttcatggtgaaataaaacagcatttaagaaaggatatga

SEQ ID NO: 467 - DNA, 1010 bp, Homo sapiens
ttgggataataagacatatgcatacaatacctcaacaatgcaagatgagttaaatttaaaagatgcattgttaaccaacatgcctggttttgggctacactaatttgcccaactgtcatcatctttcacttaacttctactcagctcccatgtttttgccatatgaacctactacctgcgccagtgtgaccccttccaagctgccccatacataaaaggtccttcaggagcacataccgggccaattaatttcagtcacatcccaattaatttaccaggccagtaaattctccatgaggatttcccacaactgttttagaagactccaataattcctgttcttcgtacatctttcttcataatcccacatatctaactctaagtacaccctggaaaattacagcatgatatttatgtatctgtcaaatgtgtctctctaaacatcccatactgatacaagtttctagagttctaagttcttcttagaacttgagtttctaaatattttcttgttatcttctttctcttgcaaactagtacccagctagagtacatgtggcagttgttcaattattgagatagacaaattcacagcacttttcttaagtagaaagttggagcaagagtgagtgggaacagctacttccaggtctgtgtgaaaatggataaatccttaataattaactcattggaagttgttagagcctccagacatgtcctagaccacattcaaaagcaaggaacattctcttcaacattggagagtgttttgtagttcaatagaaggcaaacattgggaatatttaaagcaatgtaaaaagtgcccacaataacagagtttttaacattaacaacattttctaaagtcctctataaatattgctacaagcaaagtctcaacaaccgagatcaaatcagcccaatatactaaggcaagctcccatttatacttttgacttactcaagtagtaagaatagagtttagaatgtaaattcaaaggatgaaagag

SEQ ID NO: 468 - DNA, 462 bp, Homo sapiens
gatgcactgacagactgcaaagagacaccacaatgctgagacccagaacatagagatatattgtctcagcactgatggtttatgtagcccacaaaatctttggaaacagtgagatttccaactgatatttctttcagtgatgactaaggatgataaaatatttccagttgccaaaggggtggttgtggaaatgagaaacagaaatagcccatataccagttaccttgcaacatgccatctgcgttccaccaataaatggatatcctcaattcttctgttgttggcatagtgcaaacgtttgggaaggtgctgtttcaagtaaggcttaaagtgctgatctggttttttacactgaaatagaaatggaaatcagacttcagatggaatgtcttttggaaaaattcttacaaattctctctctagaaagctgaaggagattttaagcctaaccaaaggttaatg

SEQ ID NO: 469 - DNA, 1342 bp, Homo sapiens
gaccatcgctaagagcaattcacactccaaggcctttcccaactccttcaagtcaagcagttgggggtggggtgtcggtgggaggggaggagcacatgggtttaggcttatctgattagatgctcttgtaccactaaggtcgctacccagcatccgggaacaatggagcagagtgggtgggcagttctggttcagggaaagtaaagatttgtttaaccatgaatgaatacttttcagttctaatggaaggatcagatattctccatttgtatcattgccaagaccattagggagcctgcagctgaccacaggccagaagttttgaaagttcttaaggaaacaaatatacaggatggcagggcagtgaggaaagtgttcctcccacccctccccgccgggggaggcacacacaggagggaggctgctccaggggcagaggcctgggcagggcagaggcgggacaactggaaacacttaccgtgagattggcaataatggctttggggtcatctgttcaaagagaggagaaagatttcaaaagaaataacaaccattaccaagagaaatcatttttgcagcaagatactcaattctttctccttccatcccacagaagactatcactttagtgttttgtttgaaagataaataattgtgtaggggtatttaacatttcagtcattgacatgcagctaagcaagtggaacaaatcctatagtaaactgccctcctaggtccagttctgctcttctggagggaattcctccttccatagcaccaggatactgctaggtaaattgcttcttgttttaagttccccctaatggttccccttgagacataatttatttgcagtttgacctcaggaactaaactgggcatttggggcttttaatgtaacttcttatttatctgcagatttttgaaacaagtcttcacccactttaagttgaaacttctaatccattgagttatttttttaaaagggagtttgtttccctatttatatcctgggtgtaattacacaggtagccgcacctctccagccatagacacacacgtgcatgcacctcctttattttcaatagcatcaagtaaaagattttagtcaatactctgaactagctaaaagcaaaattatgtaaatgatggctgtgcataaactgtggacaggattatattatctgaagctccccttttgggcggaatgtggggagaaagaggagattgtaggttgcttggattttgttttgttttcaggaagtttgcttcagtatgttattacagaatcagcagaaaaggaaagtggtgttcagaagagatagcaactatcatgaggcag

SEQ ID NO: 470 - DNA, 236 bp, Homo sapiens
atttgttcatatttgttaaaaatgtatgaataaacttgccttgggatataaatatacagactccaaagtctattttcagaatcttagctctaaagcttgaaatccgaaactaaaatgtgtattccattggccttaattacatctcttactagaaggcaaataagtaataatgtaataataatagcccgaatagatttcatactatgtgcctgtctttctataagagctctgcaggt

SEQ ID NO: 471 - DNA, 267 bp, Homo sapiens
aagccaatgggttttcagaaggaggaggagttggcactctgacactcaagcaacctgattgagcaagccaggcctcataaatcatattcctcaaagggacgaaataaagtaagttcatggtctttgacaatgaagagaagtaaatagcatgtactcagataagtcccagagaattactaggaatatccaatgcctgagtccatactggggacatcaatccttcaattctgaagaacttagtctttgcaggctaacagtcctcatttt

SEQ ID NO: 472 - DNA, 1168 bp, Homo sapiens
aataagagtgtatgtgtatgtgtgtgtgtctctatctgaaatagtggtatgactaagacatcatcatcatatccaacctttatatagctttgactatgtgctaagcactgatctaaattatgtaaacacaatctcttgtttaatcttcctaacaatccttaccttgcagatgaggaagcagaggtacagggcgtcacatggtgagtaccgagcagagctgagatatgaacccagacatctgtgcctgtcaccaccccatgctactgtctcccacaaaatgaaaccacattggaaagtgtttttgtaaagtacaaaaatttttatcattgatagttatgaattcatgggccatgggaaggtttttttttctcctccaaaccaacctccccattacatgtactaatgtcagaaatattgttaaaaatagagaaaatcttttttgcatagccctgaagtgcaaatactaaaatcgaggggtgccatagtgactgcatccagtctatgcgagggcagaaaagggaggacacagggacaggaaaggtcatggaggagagagggcagaaacacccacattttgtttatttcacaacatggtctggagctgaccctggaacagttccagttgtgttgactcaggaacataattagggaaaaacttaattttccaaagctgtaaggttggtgtcaatggtttcttattcccaaggctaaaaactctaaagaatttttttttcaaagtgcggcataaccccaataaaactatggacttctcaaaagctaggtagacagcacctaaaaatcttagtccacaaattaagtttgtatcagtggtagatcataacctgaacatgtaaaacataagtgacaagattattcctgtttatttttatttctaatctttcaggacagctgccacttcccaagggcttaatatcttttcctactaggttctaccaatcacttttacaaagagaatggactccattccacaaggctcctaggaacccccacagtccaaatgtggttctgccaacccttacatagaccctctagtttcatctataaaaatgatcagcctgaacttcttattgaaaaaattcttatcttataaacttctgtttatggtcatgaatatgcttcaaactaagtgcaatttccacataataag

SEQ ID NO: 473 - DNA, 539 bp, Homo sapiens
cctttgtattaccactctaaccacttaatattttaagaatcaacttacatttagcattgttgctaaatttggatcgaattcttcctagagttccaggcactaaagtaatatcatccacattagttaggtaattactcaagaactcagttctatcacatgtgacatcttccattcctatggggagggagaaaaagaatattttcaggcaagactaaaacgaaaatcttaacatagacacgaaagataacatccaggcatctctttagttagtttttagtaacttaatgggaagagccctgacttttgagatttttgtatttgactttaaatggtttaaggcttctctgtataatcttttctctagacttttacttagccatatcatcttgcaagcactagaaggttgaaagtgcattacctcgattacattttaagtcactcagccagaatagcaagacaaaggaagtcaccatgatttaaacaacaacaacaacaaacataactattgacagagtctttatgaaaaagatctattcttt

SEQ ID NO: 474 - DNA, 964 bp, Homo sapiens
ccctaggttgcatcaaactcttcccagctgggggtggtataaatggaatatacagttctgtgtctcttttacaaaatgtcattttccaactctctaatatatctcctgtcttgagtacataatcaccagtcctcactgtctccactggtggccttggatgttactgacaaaacaatactggcaacaagagatgagaaagaaaaatgtcagttccaatgaccacccaaactgaaaaacaaaataacactgaaaacaagttgtaaacaatgtaattagtcagaactgaaagctagcaactaaagcaagaaggttctaggtagggaatttttttaaacaacaaatatttctcctccaccccaagatttgttgtgtgtccccatcaaggaaaattcttttattaaaatgcttttatttaaaacattgttgtaaactcaaatcttagcatcatagactatggaggctactagagatcttattgaaatgtatgagatgacctggaacgttttaatatattgctcagtacaattcagtatgtacatattctctaacagggaaaataaccctgttggagaatactcatatatttatatcctgtaaaggatgcccaaaggttttaaaataaggaaatacaacccagagtaccccagatctggtaaaatttaactaatcacctcctaggatcccagatccagaaccttcccttgtttaatacaaattggaatgaaatgcaagaaaaaacacacagcataaggattatatatcttgcactttaacagttaaacccttaggaagaaaaatagagcaatgaagagctactatgttttagtacaatgttagcgtgggaagggaaagtccccaaatacctattaatagagggctgaaagtctttcccatttgttatatttctaggaagtcccttatgccaccccaaatgtgagcaatctcctttacttttgaagtccat

SEQ ID NO: 475 - DNA, 42 bp, Homo sapiens
aaaacactaaaccataccatcttttaagagagaggtgctgta

SEQ ID NO: 476 - DNA, 322 bp, Homo sapiens
gaagaagtgctgtagttgtcccaaaccaaatggatctactcatcttggaagcctacacactgacaagccaaggttttaacctatccatgacctttacaatgcctcagcacatatcattgggacccttctacttagatgtctggctccagcatgtgagcaaatgctcttgacacctctgggcaacttaaattgaatcagctgtgacacatgctccaacttctctgacctgtgtgtagctctccactaagccgaatgcatggagcatgacttcgcaaagggttatatctagcccactcaagaggagaaagctaatccctttggc

SEQ ID NO: 477 - DNA, 6677 bp, Homo sapiens
ctaatttctcatagatcttctaggacattctggaaagaccttcaggaccagagctagggagatttgcctaccattcttaacagaactgccaaagagtcagccaattttcatcctccgaactccactagaagggagaagccccaaattccaatgctactgtttcaatctaatagttccggaatacaggagataccctttagaactcagtctgcatgtctctgagcccccaccccctgcacagctctacagtcatataatgtttatgatgctcttgatctcctcaaagaattgatcataaatttttctacttcataaagtgggatttagaaaaactacttcctataatgcttcttcctctctttaacagtcatctgaattacagcagggccttccggtttggaccttgacttccctcagtggattcggggaaatgatttgacttacacgccacttctttgacaagaatcccatatctctgcttctttatcatatttagatgtattttttaaccatataaactccatgggctcgttttggggatgtggctggcagggataggagattatcacctgatatgtcacattcacagaagaagctattaatgtcacaaggaaactgtctgtgttgctttaaagagagacagatttttgtagaaaggtctttcctgcaaataacagaaatatataagaagtcccagcttttgatcaaaatgaacccagggatctctcaggtcatctcatacttttcaatcatggcctgatttctatccccatcttaaagaaagcggggatgaggttaagaatggagtcttggcttctaagggcaaggattcttttcctcaatatgatcagaaacattatccatctatcctattagcaaagaaaaaacaaagctttaccatggtctccgacaaagatgacgttgacacaccgatgcagttttagttgtttcagtccatccattaattgccccacaattttgtcgatttccctcagaggatttgtcatctaggaaaaagaagcaagttagtccccacagggttttctttctttccctttcagtctctcatagatcttctacccctagaacattttggaaagaaaacttccggcccagaggcagagctttgtctggggagatttgcctgccattcttaatgaaatctggtctaagcacgttatatttgtattcttttgacagaattaaaacctctcctcatccaatccctttaaagattctttgatataaaaatgtcaaaaatattgttaatgaaaattctttaagagagaaaatcgactttctaatatgtgacagcatcctttaaatccaagagttttgagagtaaacagaaagtccctaagtgaaatcacattagattttgaactatggcaagaagatagacgctaagtgaattcaaagctgttctgaggttaaaatcacaacgttgcactggataataaattagaatatcattaatacaatgagatccatcttgttctaagtaatttaactgttggcatctgaaagcaatagattcttaacagaagaacctattctaagaaacaagttattgcttctcactttagttcttttaaagctgattttgagtgaaacaagaatctataagagtcctaacttaaaaagaagtgaaccatgagtttgttctagaaggtttcttctttaacaaaatatgaaaactcaattcttttctgaagaccatttccaaagcctaaaaaacattacccatatctcattttcttacttcaaatggaagtttctaacagcatgaatgtcctcacatactagaggctctccatccccctttcatctttagctgtgcaatggaaagatttttaagaaacatctgatcagacaaagaatagaaagatacagggagtatatttagatgaattttatagcttagctaacaatcacataaatatacccaagatgattaagataagaacagaaaggatgtgaatatcatttttactcggacacataatattatcttccactagcatcttctcagatgaatcaagacctttcctcctgttatttcattgggaaatcaggtgtaaacttttgtttttttcttcatgacgggagtcagtatttcaagtcctatcccaaggaggaagccacagttgaaagtttcagaaagacatgtgcagaataatcggaagggactaacgggtgtggaacaaagtggtatttgcttctgagaaaatcatgctctgctccaagatctctgtctaggtaaagaaataccaaatgaacaatgtgttttgatctttggcaatgacttattttcctttactcagcaggatgactcaggtaaaatccagaacctacttcttagggatcagttcagaggatcacaaataagatactgcctcagaggtattcaaaggttttaggaaaagcaacaaccgataggctcttctgaacatactgggaagagtagacattacttgtggaaattacatacaactctatccgcccattattttctctttctttctgtcttagctatttccttctctataacctacaccttttctgatctctgaaggtacagacccctaatctaagccaacttcctattgagttctaatccacattgtctttgagaatacctccttttaccttgcagggttgttctcaagaaccagggccacaaaccatgtgactgattctgtgaataagtgcactcttaatagtcactccagcctaaatgttaatactagttttagggcaactaactcttaaaaaaaggaaaagacttctttttttcctgtcatgttgagttcaggcagtcttcacatcagtgttaacctctgaagtaccacattcttctggactcaaagccaaggtcaatgcaccagagtttttctaaaacttgctcagccgattttccaaccaaggcactgaaggcaaccttcaactcagacctgcccgccacaaagctttggaacaatagataaacttactttgtcctgacgagtttccgcagcataatgatccatcctatgtatttttcttcttcttttctttggaggagcaactggtctttcctgtctcctcttaggggcaactttcctcttaggtctcttagccggagtaaaaggtgagccataactactctcctgtactggcggatagagatgtctggactcagaagtcgtctgtccctctgagtcagatataaagcttacactttcccatctgggatcagcagagtctcagaataactaaggctccttaagtgagaaaaaattggaatgagggatggatgattagaggaactctatggagagaagcctcctaaattgatgttgatactgttgtcacagcttcttcgctgagaacaagaatccaatttaagaaaatctagtcatgtgggtttcttttggctgatatttatggatgtatgggaaggtggcattagacaagctctgtattccataactcctgcattagggagagactggtctttggttatgaaaagctctccatttataaagaactaactgaaaagtaggctaaatactagccacttggtcatttcaagaggacaatgaggttcatgtaagtgattccaattcagaatctgacagttatctttctgttcacgtcagcaactatgtcaaagcaactgtcaccttcattggcaaggatccagtgaaaaattttaaaaccaaggacggaatgaaacataaataataagtaatcctccttaatcataaacgtactcccacaaatcaggactttcagcaggagagagaactcactgacaattaaggttttcagtacagaggaactctaagttaaagtccttttaaaattaggtaaaatctaaaaagtcatcaaaaagtcatctcttttttgtcttggtatatacagaccaagaaagagtctccttatgctcttgctatcagaaacctgcttttaaggggcgttgcatgctatgggttttgttttgaaaatccagagagcagtgaagttgacacataaactgaagataaccttttgggatttccaaatgctggaggaaaaacaggcccctgatttgctgatggtgcaaaggtgaattaaagcagcaagccttgctgtctacctcactgacttctctcggagggtgggtggggggaatgtcttgagagccattcagatgcaggaaggggcgggaggaggaacaatgttagtgtatccaagaaggggaacatctgccatgcgatttcactgtttccagggcaagccatggcaaaggcacttctgtttctgtctcatcctctctctccaccaaagcaatcaaaagacacagccccaaagactttggttttgtttgtttgttttttaatgctcctagttttaggcaaatctccataagaaaagcagcaaaaggaaaagaggattttccgtttcatggtcactgaatacattctgctagcgctcaagtcggcccatcaaactctatgccatttgcaagagacctcaacattccaaagactccaaagatgagcccttccaattgcagcaggttagaggagcagaagagtagggtttagtcaaactgggttttcatccagtgattatatcgcatgtatttccttcttcaaatgttagaggtacatgaaagctaagttttcactgaccagccatactttagcctgaatttagaaattttagcctgaggttattaagaggatgggaggtagaggtgcaaatttccctgcatttcaggatactttgccatctgaaggtagagactagccagccaaagctctgcctgtaggcccggaagagcagccgaacaaggggtcacagaaaaagcatagaaggtcaaaaagaaaaagattgcgccaataatcaaaagcaagcatatttttgaacattcaccattacactctgaaaccaggagcaatacaccatttcttgaactattaactcaatgtttggtcatctcatttaatagcttttgagaatcattctgaaaaaatgtggactcaaatatttagcaaataaagcacaaatttcaactgaattcatcttattgtagcatatagcattttggtagttaaaatcatttcaatgaaatttcaaatataggttattttcttatatgtaaaagatacgttactgattttaaaataatctttcaactagtatgttataatcttttcatgtataataagtgtaaatgatgatatataggtaggcatataggatacacaggtgtataaaccaattagcctacaatagaagagaatttttgctgacttgctttggtttcatgttttaaaagcataaactattttgtttttcattcagttaaaataagattcctagaaccagatgagaaataattgaaatctgaaaatatcctttgccttatgagaagaaaatgaccaggttatcagattaccattactgaagatatactccaagatacccaattaagagtttatccagtaggcatatgaaaataccctagctgcaagaagtagtaatactgaaaaaaacataacatgaatactttcaactcttaattcaaaggtactataggaaaaatctctgtttatatatttgtgagcaaccctgggcatagaaaaattattatagcaaattaaagcatcctgtatgccgcttcatttattccctactcagtactttcaaaaaaacttatttgtttcttaattcacacaaacatatactttcatgcatttaattgtaactgaactacacatattagaaacccaaagatgtttattgattaagaacatttatcattaagccatataacttttaaggtttgagttatacctcatctgtattattaaaagccaaacttttgccataaagaaaatgttctgtataatttgaacatagttattaactgaccactttgcttatctcctggactgcaggagggttaaatggttccatggaagggagtgtgctctgggagtcaaaagttctgtagtgctatcttcaggttctccccttagcagccaagcgaaagtaccggagtcctacttttaaaaggatggctataccaatccgttttgcctaccccacaggttctttgaggggatgctattacccaagaagtcaaacttttaagtagggaacatggaactgcttaggtgttttgttttgttttgtgaacattttgataaaatgtggttccttttgttccctttaggttaatctcaaagaaagtcaatctaaaaataaaacagccattcttgctttggtgttctttactggcatcatgtatgcagatgtttatctcattttatcatttgtgtttcacaatcatacaagacgggttaaacttcaaagggacagaaaaagagcatctgacttatataacttcagtgatttaagactaagagtggttttacgtagctattagttactagtgcttaaataaatcacctctgaattgatgtcaaagcattcagaaacacttatgactccttggtcacatgctgcaagtattgtcaaaatacttaagtattgtcaaaaaacttaagtattgtcaaaaatacttaaaccaagtatgtttaaccaagtatgtttaaaccaagatatgtttacctgtatttctaattcatctgaaaacaatgaacttaattatagtcagcagtgtcctatgggttactaggcta

SEQ ID NO: 478 - DNA, 169 bp, Homo sapiens
aggttagatttgcaaactccatcatattttttactatctatgctgaaaatgtgggaacatttctaaccattcctttcccaccttctgaatttgaaattatactggatactacctcacagattgtcttccacaatgatggctgagtgtttgataaaaatatgtcaccctc

SEQ ID NO: 479 - DNA, 67 bp, Homo sapiens
gtcagcctgctctgctaagcagattcattcagtggtatatttttctcaagaatttatgttactttgg

SEQ ID NO: 480 - DNA, 275 bp, Homo sapiens
caaaagggtccattactataacttatgccaagttgattgtattatatctgccaaggttattggagctgcttagctgatctaccctctctaaactgcctaatcatttcaagggtgctgaaattcatttacaatgttttgcattgcaggtttcatctcaagatttttttccatgcctagcccattgaaggcaaatgccaactcttccgaattattcaccctccaactgacgcccacaaggctagaatacaccccatctcctgttaacatcaagttta

SEQ ID NO: 481 - DNA, 1357 bp, Homo sapiens
caaatcaatctgaaatgaagctcctgtaacagaaacaggtcgttttaagattttttaaaaaatttttagtcttgtagttatttgactttgcataaaccttgtagatacaaacatccatccagactttatacaattcctgaaataaagtcagtagatcaggtagcccagggccacagattcttctcaggcagatgctaaaccactaacctcagggccgaaagggccatatttgtgtccagagaaatcaggttgctcagaatagaaggcatagaccgaaggcctataagaaaattggaaggttcagaatctctcctaaaccacatgtaacaaaaaatatcacatatttttaaaaaacgcatttaaaaaaaaatgttctcaagtttaatttatcctttaactactattcatgttagcatgaaaaacttttttttttttctgttgcttctgtgaccaccaccccatctgtagtaactgtctggaaccaccttcaggaatcaaaagtcacaaaggaaaacttgaacctgtactcggatccttgaccctcaagataacagagcctggcggtaattcacatgggccgtgcaatctgcagcctgaaacaacaactaactgcattacagagaagcgtctctctttatacttctgcaatccttgggatgctgctggttcatttatcaaagccagaaactcccttcggctctgctgtagtggacagaattaatagctgcagtaatccaagtaattaaatggtcccaataaccaaagtctattgtatccttcttagggaagtaacacttaaggctaagaaccacaaaacttttaattccaaacattggctgtgcttctattccacagtctagtgtttcacgcaattctaaactaagatagaaatgtactgaagaaagaagaaagagagaaataaatacctctcatgatctggcagggtgagccactgcaatatggttaatattctccgctcgtgagggatgacactggagggtaaaagcaagcaaagcatgttgttaggtttcatttccgcaaactcaagcctgaggagtgctcgctcttgcacccaggccaaatgctctctatttaccaccatctgttttcacttcatttgtagtaaaaggccctctttcgaattagcgtttaaactactatttccatttgcaacatattacgttgctcaacctcttccacagaagactacactggaaactctgattcacagtcagaatgaggaacctgtcttgctaatcagaaactccactacaagcagaaaggaccctggtttcagaatcattgtcatttattctgtcgagcctttagctgtggccataaagggatcagtacttac

SEQ ID NO: 482 - DNA, 21 bp, Homo sapiens
atgatcataatgcgttatcat

SEQ ID NO: 483 - DNA, 19 bp, Homo sapiens
taaaaatctaccaagaata

SEQ ID NO: 484 - DNA, 505 bp, Homo sapiens
taggcacatataattaagagactgacaaaaagggtataatcttcatccacaataacttttgtgtttaagtctctttcctctgttgaaatataattaccctaagtctggcactagctttaagggctctaaggcctcacagctaacatgacagtattgcatccccggctgagttacattcagatgctcacaagctgagtgatatctttagtcaggggaaattcacccactctttcccaacagggagcacaaaatgcattttcactccccgatccaagaccaggcattagaggcatgttcatgatgaattcaaactaaagcacaagtttaaatgtggtcaggaaaaattattgtggaacattggtgagccatttaaacttttactctcagtggacatgagcagtgagagagctgggagaaggataaatcctcaagccggggctctcatcaagtggtttctcttcctcccccatcaccatccagctcacagggatttgtcattccccag

SEQ ID NO: 485 - DNA, 570 bp, Homo sapiens
tttgttagtgtaaaataagtcactgaaatggagcaaagcaatcctttctgtcatattaccaaatccaagacagttctcatccaggaatttactgggccaacctcactgtcgggaaaatgcctaaattctcaggagacgagcagtgtgctatgccacataatctcagcctctaatacttaacactataagctctgctaataactccaggtcacttgtttaggaaacagagataaagatttgaaaattttgcatattaacacatacaatctaccacccaatgttgttgactctgagtcctagatatttcaattcacttccctcctgcttgcgttctgagaacacagttatttcaggacatgtaaatggagagggatcattgctatatggtttcattctggaacttttatgtcattccacatagagccagtttccacacacattgccaagataagccccttccctgcaggaaggaatgtttctggagctaaacatgaacaatgatacccttaagtttgagtctgactctcctagtgatctgtgactttctgcaaattgtataaattctcaatg

SEQ ID NO: 486 - DNA, 61 bp, Homo sapiens
cctgccttcttcccctctcttaatcctgctaatttaatactgaaacatagacgtactcttt

SEQ ID NO: 487 - DNA, 211 bp, Homo sapiens
aacagcagtagatgaccaaaacatcttttctacagagagcatcagagcacattgtgattgaatctaaaggtgtgtttgctgttgagttcttcttgtttgttgttcatttggggaattcacgtttgtaaacaaaaatccagagagaagacagcacctagaaagaaagggaagatcaaacacaaacaggccgttttaaaaagaggtaatgagt

SEQ ID NO: 488 - DNA, 493 bp, Homo sapiens
gtgttttctttttcttttagcaagaaaatggattgtcaacagtggtaaatcttatgtccaagttagaaggtatcgggagatttttaagagtctctgggattgaaaacctgtggtaatacagacctctcagggtgaagtttacttttatccctgtctatgataggaacaatatttgctgagtgcatgaatggtgcaaacacagactctgcctccacttcagggtttgatttgataagtaaacacccctcactcccaggatgtagttctgggctcaccatatgagactcgtttgggactgagaaacttaaaaccactgaggcaaatgaaaataggtcagaatccaggtaaattgtccttagactcaaaatgacaaagtctttgaatttcagacgccaggaattgcttctgtggctccctgggcacctgtttttgtggcaacttcatacgatgttatttatgaagaaatgaatgggaaagcagaactcctctagta

SEQ ID NO: 489 - DNA, 69 bp, Homo sapiens
gttgctgcaccactcagtgctgccttcttctgggcctgactggcatcaactcactcggtgatactcagc

SEQ ID NO: 490 - DNA, 31 bp, Homo sapiens
ggatggatgaatggataatagatagatggac

SEQ ID NO: 491 - DNA, 716 bp, Homo sapiens
tctcttctcctcccatgaaaggaagtctaaagcatggctattgtcacctaagtcttgacatggaggtaccagtttcacactggcttcagatgtttgtgtgtgatggactcacctgcatattctgggacaatgtcttctcatattgtgtccatcaaaataagtgtcaggtcaattcaatagcatttattaagtatctaggttaatgctaagatctagagaggtcacagagaaaagttttcaagccttcaagtttttgtagagaaagaactgatatatattcagacaattaagaagtttatgtatccatgattcctcagctcaggagaggggtaacaatatccctagaccaggcacagatggctataagacaagagctccagtccggctcaaaatctccccttgtataggaatctctaggagatatgacccataaactcaaactattagatgtcctggctgagatgtagcacctgccatttcctcctcactcggagtattgctgtgtggattcaccttcctccaagttcagtggtgatgtcaatatttaaaaggcctcaaagaaaggagagctcactgtgtggtgagcagctaaggatatctcctggaagaggtggccctgggcttagaacagggacatacatacacaccatttgtgcccttactcccctacctcatccaatcaattatggcacaccttacactgaactcagaaccct

SEQ ID NO: 492 - DNA, 125 bp, Homo sapiens
aaatttaaagagttgatccatttctctaattcaagacagcttattaagtaaagatgctcatggaatcctaaacttaccctaaattgggataaactgaggtcctctttttcctttttttttttttg

SEQ ID NO: 493 - DNA, 1072 bp, Homo sapiens
aaggtccactttttctaccaggaagctaaggatcctagagggtcaaagatgccatcactaatatttttgagtaaatgaagaaggaaagaagtagaatgaatgaacagagaaacacactgcaattgtatggggaaaagaaaatagagggaagacgttgcaggcaaaatcatccacaattatacaaattccaccttagagtagagcccagcacgcctgggaagggcagagagaagctgatcgtacaggctttctgggagccttaacatcattgtgtcttaaaagggtgaggagcaggggaaaggaggaggaaagagactttgggactcagcatttccatatcagataatggactttaagagcatttggtttatgactgaatcttataccctacactccctcccacctctattctctccactgaacaagtaaaagtgcctcttagcacagcagattcaagagcagagattcacttgagatgactgtaccacagtgtgctcattcccgattggagtgaaatggtctcatcgcctttgagttgggtcagctgctgagatgatcagggatctgctggaaagaagcagggggacagaggctgatccacatcccacctctgctctgagctctcagggagactgacatgaggtcagtcaccatcaccgtgggagttcacagaaacagtcagcataatggagagaaagccagtggaaggggagcttcgaagatggagactccagccttctctttccccatgggagtgatgggcccaaggttaccaagcaacaaaaggccttctctccccctgccactctcaactgggctgtgttgggtggaatatgggcagagctcagttcatcactgactttatttattgaacaggttttctacctgaactcctcacctcctttccaatcctgaaatgaattaggtcatatgaagtcataagtgctcttctgagcctcccctattctccaactttccagtcattcattcactcgttcaacaaacacttacccagctggtcgaagtggaaagggcacaagctttagaattgtgctatttatgattaagtcat

SEQ ID NO: 494 - DNA, 67 bp, Homo sapiens
cttgaaagactaagcctgaaaggtagtaaggattagattcttttgccagtcattaaaacaaccactc

SEQ ID NO: 495 - DNA, 59 bp, Homo sapiens
aaggtagtaaggattaactgtgaacttactcataaagcttataatgcagtgactggcat

SEQ ID NO: 496 - DNA, 798 bp, Homo sapiens
agagacaggatgggggtagcacttgggcagacagtgtggacaattcactgcagcaaaactgtggaagcaggaaggcccagggcatgaaccagggtggagcagtgtgtggtctgtatggtggagggtctcaatgaagaagtgcagtggagatgaagctggaagtctgcaacgaccctgtagggccctgaatgccaagttggaagttttggccacgtctgggtaaatgatgacattaaacatggacaatgaggtcacttaggatctgctactaaggtaatgtttgaggccatgccttcccttctccttctctttggatagacgctgtaaggaccaaagtgccgggaggtattccatgcgccccaccgtcacggcatatcattaacccaccatcattcccagcctccacagacttctgactcctctgtttcccagggggaaactcattctcaacaatgtgtcacccacataaggggaccaagtctgggaggtggtgtgggccacgggcttgctcacaactcagtgtcagactctcgtgaggccccagtcactgacggccacaacagcaaccagacaaaacagaaactgcccttcaccagctgagcttccctcttaaacatctctgaaacccatcagcttctgcatcactgcctccctgctagctcaggcccccaccttcccagccaaagggttctatccaaaacctctggattgtaacacaccctgtgtgaaaccttcactggctcccattgtccaaggacaaactgcagactcctgtgcatggactttaagatgctccca

SEQ ID NO: 497 - DNA, 353 bp, Homo sapiens
gaatgagtagaggctaataacagccagggctaagataatgtattcaaaaagaagcaaccagaaactcaaaatactcagtgttcccaaaagtgtggagagctcagtttgaaccgggggcaggtctgaaagctcccagcaggctgaggggagccctgttcaatcaggctcaccccagcctggatcagggtattctgtggagaattgtgcaaaatggtttggagtttttgttgtttggtgggggtgggcaggagccaactcatgaagggtggggactgctgagagctgggtatgacggctggagcaggatccccccaagcaagaagggctccatcaggattcaaattccagcttca

SEQ ID NO: 498 - DNA, 464 bp, Homo sapiens
ctagctgagggggaaatcctttcatgccaagcacagaaaccaaatccaagccctacagattgagctgggtaagtgatgtttagggcagagttgcagcctggtgagcacccaggaagcagacaccctgaagggtgagctcaaagcaaagaccaacccagactccacccactggagcatggatatgatgcccacagcctggactggctgggtgggcagggctgtgcctcttgagggaggaaggaggagctctgagggtggggaagcttcctggacccctggttccctctaggcctcctgatgttgacgcaatcacgtatgcaagcagctggggccacagcggtagataagcaattcccagccaggtagtcacagtgctgcctgtgagtgcaggtgggaactgcagcctgggtgaacagagtaggtgcctgacttcctgggggtggggggtggctccaagtgtgctg

SEQ ID NO: 499 - DNA, 151 bp, Homo sapiens
aatgttatgatccggttacattgtaagagaatgactggctgctgggtagaaagagactggaaagggtcacactaatattctgaaaagcatgtaagctctggaaacacatttgggttcacatttctgcttcaaatcagcaaaatccagactg

SEQ ID NO: 500 - DNA, 21 bp, Homo sapiens
aattttttttttaatatatac

SEQ ID NO: 501 - DNA, 1212 bp, Homo sapiens
gcaagggctatgagaccagtccttgtctggacggagtccctcctggaacccacatcttctcactgacctggcagccccagggatggcctctctgggggagtctcaaagaagaacctgaattccaaggggagctcactgagagctcagacttaaagtctctccagaccaggattccagccctaggatgaccctcaggccaaggccaagtctgcccctataaacctctcccaagctcagcctccctatcagaaagccaaggcaggagggtggcatccacatatgaaatcccctagatggcagctcctccccactccctaggaccccatgccaacccacacagtcccccggcgacacagtgcagccatccatgggcagcagccagcctgctggtgtgattataattaagtcggtttccagcatcctctaggggctgctctgcccttttctccctttggtcattttacctgtcatatggtccccagggtcacaaacaattctcaacacggtttttgattaaaatccagtgaagctgaaaaccaagccagattcataggataaaaaaatgttagccactacctcagggaagtcaacttaattcactgtttgcaccagggaaaggctggtatcagaagtaggccttaaagtccaaggactgacatctttgagcacctaccatactccagatctgttaattacattctttcacttgatttaccaggagtaggtggtcttcatgtgtgcctctctcctgggagcccctaaagtcagaacagaaactccaggcttctgagccctctgctccctctaactgggatgtcattcccctgtatctctgccctgaacatcatctttccatgacagctaaatgtgacaaaccccaagtccagcaaaaatcacccccttttctcatctcccaccacccacatcctttacagtacttaccacacagcatgatgataagccatacacatgctcacctccccctcaatccccagactacagattccttgaaggtagcagggaaaaaggcatttttttaaactggagaatgtccaaaggagagcgggaatagtggcagcccataaagaacagtaggaggaactggggtggaggcaatgaataataagaaaaataataactaacattgttaaataattccaacatcctgggcactgagccaagtgcttcacctttggcagtgctttctaaagc

SEQ ID NO: 502 - DNA, 496 bp, Homo sapiens
cgaatgctcccaacatagatgaaattgagagccagagtttagttaagggacacaattaaccccctgccccactttgccaattatatccccaggacaaattagccaagttagaaggacacatattgtcaggagcagggaggggttgctgaaatagtttcacctgctgttctgctcaagttggtggctgccatttattttggtagttaacacattaattttggtagaacacactgtgttgctcggattttgttttatcagttttaatcaaccaaattattattttgaagtgcaatgacaaaataatctctagtgctaatgtttaaaactccctcatgatttaaactacagtttgcgagtttaaaagaagtcttcagccttctttttacccctttttacccgtttaccctcgttttagaaatgtttctgaaagacaatttttgcgaatgtgagtttcttaggaatgaagttgtcatgtgatagctgatcaggctgtagc

SEQ ID NO: 503 - DNA, 233 bp, Homo sapiens
agcagtaaaagccatgttcccagtgcctagcactctgcctagccgccgcaccccccttcctgctgtgctcaatcgattattagaagaattaagacgttaaattatgaaacgattgtcagaataatatagaaatttggactcccagggaagcgttcttttctttctcagaaacagccaaaatgcctccaacaccctttctccagatcaggtcacatgttaactcttttcatcat

SEQ ID NO: 504 - DNA, 255 bp, Homo sapiens
atcatattaaactctctacccatttgctttatgtatggcctcacctgatttgatcaggaaaccaatttattcataataattacttacagagcaggtggtacaggaaaaatctttcctgtttttcccagaattggcaataagcatcgcaacttagaaaaaaaggttgctacggacaaccttagtttggagaccagcccctgtgagctagtggtgctggggcctgtttccccatcctatggacagaccgctggtggg

SEQ ID NO: 505 - DNA, 354 bp, Homo sapiens
attaggaatggaaagggaggataactctatacactagaaatttaataaaaaccttagataatagtgaacattttatattaataaatgtgaaaacaaactggacagtgttctggaaaaaaaaaatgaacacactacaaaaattcactccacaaaagtggaaaacatgaccacatcagaaaagaaaacttaagctagtatcatttacattaatgttaaaagcttggaaaactaaataactttaaaagttaactagcttaactaaaaagctaaataactaaaagctgttttaaaaattaaacaactaaaatctttaaaaactagaagctttattaactaaagctagcaatttttttc

SEQ ID NO: 506 - DNA, 169 bp, Homo sapiens
agtaggctgaagaatagctatgtggtgactccataaatgcagagaaaagtatttaataagattaatgcacatcaagatgaagaaaaattcagcaggcaagacataaaaaaactttggcaatctgcttaagtgtgtgtctctaaaaaaccaacagcaagtatctcacata

SEQ ID NO: 507 - DNA, 110 bp, Homo sapiens
gatttagttgacattttcagtcagtaaaagggaaatgattatatgtgaaaagcaacattttaaactttttttaaacagtctatctgttacctacaactttgttttttttt

SEQ ID NO: 508 - DNA, 71 bp, Homo sapiens
aagtccctactgaagataacgggtttcaaatgactccaagtgctccacatcttaaaagtagtcccacaaag

SEQ ID NO: 509 - DNA, 1527 bp, Homo sapiens
gggatttgatcaatttagccccttgacagcacaagcccacgagcctcactttgacacctttccccagaatactacagcttgggagcaaacggcctgcacagcccccagctacagaaaccatgcatgaactactgctgtaaagtgtaattctctctcctttgcattaagctcctgcagggctctgattacacaggaaaagaaaatgttgctgaagaagatggctcttctgggaaacctgtctccagcactctgcaggagggagaggtcctcccaagctcacatttagtaagaagagaaggggactcttcaaagagatgagagtgcatttggcttcagagtgtgccttcgccaagagagggtgcacttcagcaggcagtggcatcaagctctcactccacaggatgaccaacgatgtttcagtcgccctttttctgatgcttcctaaacaaataaagtggcagtaattctagagcttaaccagaagaaaactgcacattccctcctgaagatattgccctgactatatccatccggttgttactcctacataaatgttagcctgctacatgagtgtcctgagactttgatgacatttaaatcagcagctgctccagcctcctaccttcaagccaactagcagttcatttcccaaaagagggcatgctttaagggctaatgtctcagccgacactgggctgctactacaaaatgcagagcagggaggcacgcggggccaggtgtccacaacaaatagaaggtgtcctgagcctcaaaaaccggccgtctccccatggaggtcagcacaggcttattcatcaactctgctcttgtaaacacaggcatcactgggtataaaacatgccatcaactgagtggggagcattttttctataacccctgttgccaggtcatataacctattgccaggttagatgaccatcacaaggatgatcagccaggacagaggggtgacctggtgacctgggtcatggtactctgcagggctccctagctgtctggccagtcattggcagctctgcagaacatcaagcaagttacagggtggcactgaaagctgatgggtatcgagaaggtggtggccacttagaagccccactggggccttcaagaagctgatcacaaggtgcatgttcttagatggacctctgggcagctgcagagtgcaggcttactacccagatcagaaaccccatgtagggtgaggattgtcactgagagaggaactggtggaggaagttctgctgaaaaagtcctggtgaccccatcccctgagcagaatgcccaggtaagccacctcctgtctcttcctccttccttctctttcatgcgaacacagaaaaggcagcacagcagtgacaccaaccacaccgcagttcccacctggagaggaggtgaggtcaaaaaacacatgccctgccatgccggctggccctgaacacaccttcctccatgcacacaggtagacaggtgaatcctgaggttactgttccaaaactcaccatgagg

SEQ ID NO: 510 - DNA, 28 bp, Homo sapiens
gattccatctcaaaagaaaaaaaaaaga

SEQ ID NO: 511 - DNA, 53 bp, Homo sapiens
ctagctatctggccagtcattggcagctctgtggaacattaagcaagctacag

SEQ ID NO: 512 - DNA, 99 bp, Homo sapiens
gtggtttgagtgccagatcggccgcaatacaacagaacactagatagacttctaagatttttgactctacttcctgactcccagacagcacctctggac

SEQ ID NO: 513 - DNA, 1302 bp, Homo sapiens
caaaaaacatacagtggatatcaatccatcaagagagctcacctgaatatgccagtccctggtggatgctgctgtccccagtggtgggatcagcaagcttattggtctgtctatcccaacaagtgaaataagcatgccaaggtttgaagaactacacagaaccagccaaatggaaaaaaaaaaaaaaaaaggaattctgaatagttgggcccatgtgaggtgtcagagaagctattattttttgagatgtaagcctttctaacccaaactgccttaaatgcttgcttcgtgagcttcaagagtgtcgcacaagtggggagcaggtggggataggtcccagctcactgtggaggaagttctgggttccaggcagcaatggctgcccgaagaactgacatgctcaggtagctgggaacagccctgaatccagagggcagggagccctgtctggagccccccacttcacacctggctatgccagctgcagggctgagactcctgccagtgagatatgagcccctgggtcatggctgcagcttgctggctgatactcggtgtccctctctctggaactgtgggctctctgtccccgactcagaatggcaattctgacccctctaccaccctcagtcccatgtggaatgagagacagagaggtggagtctagtctctatgaccacgtgcccatgcatgcctgcagagcccaggccccacagccctgcccccgagtcacatgcatggcccacagggacaagatcaatgtccagtcggaacggggagctcggttgctcatgctggaccggcatggccgtttcctgctccttttcagcagtgaccacaaaccttctcctccaacattcagaaacagcctgcatccggctgaaccacactcaggcttcctttacccctggaaaagcccactctacccagatgctactgatgtttccctcctggtatcccaaaggatgccacacgcccctcgcctcctgtgccagtactccaccagcacacacctttgagtcgtaagaacagggctggcaaggggcagaaaattgtgtggactggggttgccattagaggaacttggtgaacaagtgaaccaatgaacaagcactttgagattgcagtgtttatgcatttgagtggaaatgggccaaatgcccctcttcttaaaaggcgatagcagttttctaggagcacagcttacacctgtgagtcctaaaggcagctccataagacaccaactggccctggagaggtgagaagggcggtatattcatcagctggagctgcgtggctgtg

SEQ ID NO: 514 - DNA, 749 bp, Homo sapiens
ggcagttccctccctctgctctcaccccttgacctctcttccaatttgcattcacctgctttggcttcctctgagatgttctcaatactccttccttttataggcttcattccaggcatttgatcattttccgttcatgaactcttcgtctctgttctatgttttaggatcttttaagggtcctattatcctttgctaaccaccaaaaagtgaagtctgcaacctggagagccttcccctgccttgggctgctctgtgagctgagctctgtggtgctggggtctgcctatcctgctttggagatggattactccagtgtctcccacatgattccaggctgtggtcccttcaacgtagcagaaaacctctcccccactggtgcccttttcccccacaaatccaagccaatcctgaggaatgtcactgggatgaccaacttaagccagatacaacagtattgtcaatatcagtgctggcactgcccagacacagactctcagctcaaacccatggactaaaactaccttcagactgaaacctctgattcgtaccagggccacgattcagcctggatttcaacacatctggggccatcaggcaccagagcacaatgccaccctcatagccaacagcaactactgaccagggctttaacacagagcctgccattggctgctttcactgaggtgtagcaggtcatttttggaggagtcaaaaaacatttgttggagattgctagtcaattagag

SEQ ID NO: 515 - DNA, 511 bp, Homo sapiens
atggtgcttgcatcattatttcatactcactgtagggagtttctcatctgcctctcaaactgtgttccaccttatctgttctggtgggtagaaggcaaagcacctggccccgttacagttatagctgaaccatgaccaatgagtctgagcattggatggcatgaacatcggagatcctctcctgtgaatctcaagtgaccctccttgcccctccccaactctcccactgcgggattttcccaggacagaatctcagaatgagctggctctacaggcactcacagatgcacccttaccttgacctgcaggcctgaagccgacccagcccacaggcagcattccgagctgacacatcaagaagctccagatgcctccccgaccttcacaaatgtgaaacaagatgaaggtgttgacagggctggtctgtagaaatagtattttgttattactgaaatgttagagtgtaaaatagaatgttctgttcctctctagccacaatgtcccattgatt

SEQ ID NO: 516 - DNA, 1144 bp, Homo sapiens
ctgtggcactgccatttctcaagctacctagaagctagtttgaacagtgtgtgtatttaaagtaaatttcatttgggacattttattacagaagcttattatctctttttaaaggaatctttcttctcaggatcttaaggcatcttatatccattgaaaaggcctcctgtaccatgacagcttcttcaaaggacaccctagataatagcacaggaatcccagggagatgaaataccctgagatccacagacttccctgagatggggagtcctgtttcctcctctaccaagctgctaaccagtggccaagtcagattaagctgtatttcctcccaacccccccacccccaatctgcagtggaggaggttttaagcaggcagtggttaaatcctggaaggagaaattagaggaaatgaaaagactctcccaacttggatgagaaagtggtggagtgacagggtgggcaagaccccagcaagctgtccggggccaggcccatccaggagtccggtgtgtttcagtgtctgcccaggcctcctgtctaggaagctttcctgccaggttcagaaaatgaagaacataaaccacaggaccctattttatgggtagaaataatgtcaatgagggcaaatggagaagagtgaggcaacagccacatccgtccaggaaggatgcctgggacacaggtggttctgccaaagagccagaaggatggaaggaaatctcaaaattcagatgagaagccagacagtaggaaagccaaaaaagcacaatctaataatttagaaaatgaaagaggaggagggctgttaaagatattctctgctccttcgtaacatctcagctcctctcttcctatgtagaaataaacgctcactgcaaaaggcaatgatttgcttagaaaaaattcatttaaaatgtcttgcaattattgacactgtcatcagatcttggcagtagcagcttattattacctcctatgtatgtttgccgggagaagagtctcattgtttaggagggagaaataaagcaaaagtccaagggtattgtgcttgaaatacatgcctagagatatggagttgattgccccagaaaaaaaaggaagcctatgtgtatattattattcacctcggtagcccgaatc

SEQ ID NO: 517 - DNA, 525 bp, Homo sapiens
atacagttgagctcagctgggcagccatccaagtgattcatattaaattctagctatattcagcacaaaagtcatctagcatcagaggatcaaagttacatcaactaacaagcactgggggattgataagctgctaaaattaggtcattgcatagcagcagcctttgatggatgaagtgaaatttagccgcgggtttgctatttaaagatctgttacagcaccctttcctgtagccacaatgaacacacaacaaagtatcatgtgtctgattaaatgtttaatcatcgctgttgagcttgccgactgtggcaaagattcagtttccttaagagtgcattcagctcttgggccaagccagtacctgcattttaattcccacatccagagccttacaacagggcccatttctccctcctcaggatgaattctgtaaagttagtttaatcgtttttaaaagcatttggtcacacagttccacctctaagtccctgtcagttcagtgtttcaaaactcttcgtcagcgt

SEQ ID NO: 518 - DNA, 1446 bp, Homo sapiens
ggctccagactgcccagtggatgcagcaactggtctggtgagcgcatttctgtttcttgctcattccctcaatttcagaatcacacacctgtccaaaatggctcacgtctctctcttctttgggactgtttttgtttccagatgggttaaggtggggatttgacttcatttggtttaggttttggctgtggctgaggccccaggcatgtggcagtcaccagttctgatttcataactcccatggccaggccaggagccacacaggaagccggaaggggcctcgggtcagtgtgtcctgtcccagcagcacggggtgggggactgtgtgcccccaggtgtcctatccacccctcagctccaaagggcatgtggacatgcgtcaggtcccctgaggccatctacaaacaccagatggactgttgagcttcccaggctcagaacctaagaacccgcaactggaaggaaaaggcagcagaagatgagaaaaacggtcagggaggaaagaaaacactttaacccaaacaaagtttaaaataaaataaagagtggtgaacactcagctgggagaggagaggaggcctctgtgggcaaagggaaatgctgctgagaggcagctaagcctgagtctggaagactggagggaggcagctccagggtgagcacctggagtgcacaaggctctggaaggggagggcaaggggtatcaccctccccagagccccagggaagcctgattcatcagtacacccaggaaggggctggctgcagcgatagccccctgcccagttgtcccagatgaaccctgggcttggaaacagtccagggacactggcagactgagagccaccggagagggtcaccccgtccccctcctgcctgtaggggcacacaggtttcccactaaccctcagtcccagttgaccaattaccagataagaagattggatcctcctatccttacagacacaaggacacaggtgggaatggcttttcatatgcaaattccatgccatttgcttcctattccagccaaacagttgtgcagaagataaaacgaatcagggagtgctccagggagtgctcccggctctcaggagtactgtagggagtggagacaggaaggaagccatgacagggaaggtgacaatattggcccggtgctctagatgcagttctgcaggcgctcactgaagagactgctggagaaggcaggaggatgtgctcgcggtttcctgtgatgtggtgagggcaggtggagcttcagcacccagaggctggagggagatccttaggtggcccaggtgacgcaggagcctgggctttcactcagattcagaccagagagacaaagtaggaaacttgattttaaacctgggagtggctgagtgccttgttcttggctatgtttcagtgtgatcttacacatagctacccagcacatctgtc

SEQ ID NO: 519 - DNA, 449 bp, Homo sapiens
atgctggagggtggcagtttacaggcatgcactttcacagtagtaggatggggctaggagctgaagagcatgtacacagcacttgctacaacatccaagattttattttcaagagatgctttctgaaagcttagagttgagccctatgtcatgggagataggaacaaaaaaacctcattagagtcacaagttgttttcaaggttaattcaaagggtcacgtctattcatgttcaaaatcccagccatgtgtatctttacacacagtagatgctcagatcatccacctaggtgatgagatgtatcccgggcatgtgggcacttcaaccagaggcctatccttgaggccagtaagttactgcacgtacattacaccagtatgatgctgtcattattaatcaccttcatctatgtcatttaaattgtatcaggatggtgttgtaggtcatgt

SEQ ID NO: 520 - DNA, 370 bp, Homo sapiens
atgaaaggaattttgctagaatgaataattatgaaatgcaaattacaaggaaggtaacacactaagccactgggggcacaaagatggccttggggaaagcccccttgcctatgcaactatgagcccacatgccatgagccttttctcctaagaactatgtaagtagatctgttggataagttccaggaagtgacatatttcttttaaattttttttagatagtgtctcatcttcccccaaagagatggcaataatttatactccactcatagcctctgtgaatgcctgcttcagtagagagtcgacaatattatgggttgtaggtgtctttcctttctgataattggaaaagcttttcattctttcacaa

SEQ ID NO: 521 - DNA, 1287 bp, Homo sapiens
tacagatggaaggggccctgggattggaggtggggagggaggttcatactcactgtaaactccatcctacagttagaacttttcatttccatgttcaagcatttcttctcacacacagaaaacctacttaatataaaagtgggttcttataaaaacaaaagtttgagcatccctgctgtacacccttaggcttttgcacaaaaatgggttcaggcttctttcatccagatcttgaactaagcaacccataaaaacacagagctgtgctctgtgtcaccaggtacattagaaacttcagtccaacaaccaaagataaatggaagcagtttaggtctttaatgcagtctagggatgacagacaatgttcccattcagtacacctagaaagaatacctgaaagaaatgtgaccttacaggtccctgactgctcagcacccctcccctaaaacctctctcctcctccctcccctccagcacccttcccggcctgtccaggaagagcaactcccaacccagctgagccagcttgtgcagatcacatctgcttctcttgtcacctgtcctggattctggacaacagaggcgggccaagaagcaagtggaaatcctgccttttcttgcagcggggatctcagtagactgcaaacactgacaagttatctttcacgcatgcctcagtttccttccagctttttgtgctgttccttctacagcaagaattgctttgctgaatgctctcctggggaaaataatttaattgtttcaattgtgccaattatgtacttaagggtcaatgtttgtttcctataacatagcagcttaactaattaaaaagattaatcttgggtagaaaagagcctgtatttacgcaaattacatgaagcaatgacttgcacacagggacaagagtgtcctgccctgcaaaggcttactgaggctgcgtggagtccagggtgccctaactgtacattaccaccctcgggggcatctagaacccaagatgaccacagcagagccttgaggtgcggcaggatgccagaactttccacagctccccagaggaccccagcaagtggtgggggccgagactagaatatatggcctttggttggtgatcagagccttttttcttcccaaagggaattttctagaggggaatttaggccaaatcaaaccctcacatccctttcactcacagatgctaacaaatagtaacaaaccagaggaaaaaggaatcttatttgggaagagtcctcaaaaagtatgcttttttttctccctcaccga

SEQ ID NO: 522 - DNA, 900 bp, Homo sapiens
cttcttaagtgatctcctctgcaaaaccacagcttccgcaccttcacactgacccagggatgaaggcatgcctggaggccgagctgattctaatggctccactgccccttggactattaggatggtcaaagtgcctgcatgtcacccagtatgatgtgacctgatggtaggaaccatgcgtagcctgggttcatctcaggcagggtcatggactcactcagcatattacagttgctgttctcaatccaccagccgccctctctggttagccgatttggggtctcctgccttaggtggctgggctctgcctcattacttccccccatctcctccctcatggatgtcaattccagggactctgtggttgttggtgccctatcaccaccgcgtgcattttagggtctgggggtaacttgtcacctgatttggctctccattattggccatgggtttttggtgttgctctctaggtgctcagtttttcactgtgtgtgttggaggagcatcctgagcagagcagatcccgacttggacagaaaccttcttggtttctcggaggagtctcctctgtgagtcttccagagcccgccctgaaccacatgactgggagctcatcgggcacctctcctgggaaaaaaaaatgctaagtcactaagcaaaaggtcaagttgttttcagaaaatgttttttaaaaagagaaggaaaattatgatatggcttataaacatttgtttcaaaaattcttatttctaaatgaaatttaatgccacttggaactttatgcagaataactcggtcttcgataaatctgaataaatgtacatatgtaagtatatatgtgtctctggctttctgtaactcaaattcagggtttaaggtttgcattttttgagaatgttg

SEQ ID NO: 523 - DNA, 89 bp, Homo sapiens
tgaaggaacatacctcaaaataacatgggcaaacattataagaaagaatgatgttgtagcaaaagaaactatcaacagagtaaacagac

SEQ ID NO: 524 - DNA, 744 bp, Homo sapiens
agggtatccctgtacttatcgagtattaaattatgttgtgacttctttctttccttgactgtccgtcgggccagagccagattttggattcatgcgtgtgcaggctgctcagtgtccatgcttgtcacgggtgttggcattggaatcagaggcagcatctgctctgtcctagctcacaggcttcctctggcagagcacagggaccagggctccaggttaggctgcaggtcaggaacgagttagttcagaatgaaggcaggtactgtgtttcattttggttttattctgttatgatttccttgcttctctttcctggtgaggcttcatcttacctgtccttggccagtccttccccagatctttctggtaatgagctttgttagctcaattaaataatgccacattcccacaaaagctccgtgagtgacaaaggattggctccaagcatccaattgccaagcctcacatggcttcctgagtatcaggtgacctacatccttcctgcatttctgaaaagtcatcagttaaaataactctggagctccaggaagactgggcagctggtatagccctttgcaaaggtgaaagccctaaaatcacacatgacagctggtcaaggtgtccccaagagctggtcaaggtgtccccaagagctggtcaaacacaaactagaccaaggatgtctgcacatcagaaaagctccacttagaaaacaaggaataaaaacaacacgggagaataagg

SEQ ID NO: 525 - DNA, 1278 bp, Homo sapiens
ctcttgcggcagacttgccaggtgccaagctctctcccctcccctccctgtgtgtttcatgagctatttcccactggtacatcctcctctttactctctggcacagccaatcctgcagcttcccaaaagtccagcccagtcttctccattcaagccaaattgagtcctgccaagctttgttctctgataactcactcaagtctggggaccgacgtatatctcctagatgtgaccctgcctcaggtttataacatcattgaatcggccaaaatgaagttaagaaccttggcttccattggcctcttcctccaaagaacccagattctgtgcaatgataaaccaggcaactgataggtacacagcttggtggcttctgcagagcctcctgcacttgtaaacattcatcattcaaaccctgggcaatgttaaaacagcatcacatcacacagtgcatttcccatttcaaagcctctgaaaatgacaggaagatggttcccagagcaccctcagagccccctcccagagaccacaacaactggttaccagaaagaacacaggttatgtctctcgttcccacaacttatgataccagcgcacagatatcagatgtgtaaaagcctgacccacagcttccttacaatataaacacatcatttctaccctatttcttttcttggactggtgtctgatggggagaacctacacttccaccaccaatagggaggattagttttctgtttctttttttggtctgcgatgttacttatttcttaattagcatttgtgctgacatttctcctgctatcttagagcctagaaatgacttatttggggaaagcttaaaaaggtattcattcagcctttctttccccagtgggaaatgcgatagaggagaaaaacaattggatgcccttcactcactcaaaatcttcaagaatttaaaccatctccaccagcatgaaaagtactcaacagtaaggggcatggtaaggaagaaaacggatctaaatacatacgactccgtacagaagggatgagggttctgtagggcagatacacacagatactcaaatatagacttcagcataaatagatacttcatttaaatacattcggccaacagacatatgtggaattatggggcaccactatttgaaactcacaatggcaccaaggctggctctgaccaccatctctacctttcccatccaagagctgcttcaggtggagagaggtgaggcagagaaaactgatcatgatgacacagctgctgctggt

SEQ ID NO: 526 - DNA, 125 bp, Homo sapiens
ccaggtggacaaatgaaggtgggaaggtacaaaggggccatgcaatatgcccaaggtcaatgatagggctgagatctagacccagcttcatgcagctctctgcatatgtgctaaccatggagtgc

SEQ ID NO: 527 - DNA, 703 bp, Homo sapiens
tgttgcaaccaggaagggcgccctttcatcatgcggtgagagcctcgggcactgctgagacagagcaagggaggaaccaggttgttcctgctgcacgaaccaaagaaagctccactgcaaggcctctcaagtcggcccacctgcccctaagcatggaggccttgggatgctcctgggtgaggacatctgcccagagggctctccttcttaagcctgtctccttggggtctgacagacaacagtccctaatgtgacagcagcccagctgggctacctgctcaagcccccttcaccctgagcttctctttctgcccttcccagcctcttccaggggcttaccactgcctcttagtgtcctctgcacaagcaagcagctgaggtggccgctgggacttgcagactcaaggcaaggtcatgtggtgaaggcaagcaggaccctacagcctcctcctgcctcaccccagaaacccaggcttcttcctgcagaagccgcaccactgcagctgcgccaacctggtcgtgcagccggcattttaggaggtggctggacaatgacatgtgcctctctgttccaatcaacgcctatggctgggcctgttaccgggactgcatgtgtgtgaaggttacggggtgatctctctggcatcatcaagggatgaaattctgcgttactgaaatttctacatcattgattgttacatag

SEQ ID NO: 528 - DNA, 108 bp, Homo sapiens
tgaaccatctgggagctactcttctacgtaacctgactctttgccaaaacttgaaaaggccatttataaaaattctaaaaagcatcatttcctcctgctctgtgaatg

SEQ ID NO: 529 - DNA, 223 bp, Homo sapiens
ccctaccctcatgtttatttcccttttctttcttccttataacgtgttatcagtgttctgttatcaactctgctcccccaccacaaccaccccccagcttcccacctggagctgtatgctattgggaaacacacaaccttattacagttctgtctgaaataagatacacaggcagtgtgagggacaggaggacaaaatcagatacggaacagtgatacatata

SEQ ID NO: 530 - DNA, 82 bp, Homo sapiens
ggaacagtgatatttgaaatccaagttcagtattgttttcttccacaccacactctcaggtcagtttttgtctgaactgtca

SEQ ID NO: 531 - DNA, 660 bp, Homo sapiens
accttgaagtatcattctttagagttagaccttacacaatggaaagactcggagatattttcaagtataaacaatttgttgaactatcttactaattttttgaaaatgagtaatgcatccagctggcaaggttcactgggtgtaaagcatcatgcattcttaatttggaagctacatttaactacaatgattattacacataacaactgacaggcagggaaagatgtgtcctgcaagatctgatgctgtctcccagcaatcgccaagtgtgctgctttcctgcttggttaccaaccagtaatgaaatctacttttatttgcaaagtataaagaaaagtgagttcaaagatttaacaaatggccatcaaaagagaaaagaactctaaagtatgaaaaacggcccaaaacaatgtctaatttgaatatggcctaaggagatcacagttacctggcttttcctgcctggcacatttactctgcctggaaactcccccgtagcagccaattaccttctcaccattgggtaagaagcagacagacctgatattacaagcactattgactttgaaaagatcggacctgaatctcacatgttaagagattcttaaaatctctttttgagaaagagattagccaaagtacaagaacaaagtgggagta

SEQ ID NO: 532 - DNA, 176 bp, Homo sapiens
agcccaagtgactgttactatgctgagatttgttagcatgtcagacctcagaacactgggcagataaacacccagcagcataaagggtcaatggaccatacagatgacttccctggattgacatgatcctaaatgtgatacccaagtctgccacttcctagtcgtgtgcgctgagg

SEQ ID NO: 533 - DNA, 431 bp, Homo sapiens
gtatttttccagaaagaggctgcggtgaattctactaggtctataagctgggactcggaaagaaatgccacagccactcagaaatcccattgccaaaagttctatcaatgaagacgtgattgtccacactgtgaaacatagccatttctactcctacagctacattcacactgtgagagatttgggaacatttagggtggggggcaaggtcacttgtgctggtgcaggcatggccttggattggggaacctgctgttgtttcatttttcagctgtgggctctgcctaatcactagctttcttgggctgtcatggctctggatgaataattagcatggagtgagcactagctcgtttgaggaataatcttcttaagaggtatgcacctctcagatccatggcaaacactcatcatcatcatcatcgtcatca

SEQ ID NO: 534 - DNA, 1171 bp, Homo sapiens
ccatcaggcgtttccagatccctgaatatgctagatttctctagaaaacagatgacttgcttcctagagctttcatctgcattaagcaataatctccataagttcctaccaactgtatatatagaattatcaatacttaagtctatgttattgtatactttaacaaaatcagcatagaatcacattaaaatcaaataaaaagccatcagcccttaaaccacattcttcagtatggcagaaacagtgacaatttctacatttatgacactgtgggatagtcctctttttttccaaattaaagtctacggctttgagtagctaggtttccttctttggaattgtttttccatgaaatatgtcagaagtaaacattccttgttaattatatagcaaagtatttgcccggtggtcaattatctaatcattcttgttgaaagcaatcaaactgaagagcaaaagttatgtgcagatggttggattctcatagctgtaggcaagtacatttcaggactggtttaaacaagaataaaattaagggcaactcattgtaaccaacgaccttctgtttgaagcatgaaatcatgaatgtgttgaatattagaaattaacacgatgactgtattcagctgcaacacattccctgggtatttttagggtagtttttgagaaagattcttaaatttaagcaactgatttttttttctttaagctttagctgagctatcgtaagacttactgaaacaagttttaggaaagaagcagttatgggaaaccacaaaatactggcagacttatagaaactttattccttaaatagatagctagacgtattaggatacataatagcattaataaaatttaatgagagacttctgaatttacaatagatatatatacatttcctgaaagtaggtcagaatacaagctaattagccccatctggagagaaattttgttcattacccactgaggccaatacccatcttgcaattacatgtcagaagggactgggtggggagcacacaaggattgtgggtggcacagccattagtcccctgcattggaaaaatcctcaggatgaaagacagcataacagataatttgcagagaataactgagcgttctcataacagagaaattacaaatctggagacatgtggtaggatgcttg

SEQ ID NO: 535 - DNA, 227 bp, Homo sapiens
cgcctctctaaattatttgcccttttgtgggtgtggcaactctgtcaggcagagttgccacacccgcaaaatgccctaatgccatttcctaccatgtggctgtagcgggttcactaggtggccagtgcttgaagcaacttctgaaatatttctgatatattcaagaaggaatctggtcaattgtcagactataggccaggagtcagcgcactcaaatgcctacagat

SEQ ID NO: 536 - DNA, 279 bp, Homo sapiens
tttcaaatgcctacagatgccattgtgtccttgcctagagggatgtgttgcttagtgacctggctggttccaagcttgagacctctgcactgaccactgttgctgccagggatgtcctgtccccgagataagcccacgttaggattctgggtgttgttaggatctcagctcaaatgtcacttctccaaaggctctgaccagctaatgactctctccaccatcactctgcttaattgtttctccgccatctgaaataaactagctcattctcggtctcct

SEQ ID NO: 537 - DNA, 344 bp, Homo sapiens
gaaacaggtggttgttctgcattcccagatcagcccatcattctattcagccacattaagtcttggcattgaagcgggaatccacaaaaatctgataaactgggaaaggggatttggagtctgaagaaatcacgttttgtgtctcccccttccctaggatgtcccatgagtgtgggaaacactcaactctactgagctaaagttcctttctgataaagacgggagtcccccacctccagggttgctttgggaataatggtgtaaaatgttggtttataggaatacctgtttttctaatggataagctcagctaagaatgaatagataaaaacattgttttttca

SEQ ID NO: 538 - DNA, 198 bp, Homo sapiens
cattttttttccctaaaggatctaagttgtgatcccatttttcttccccttcagtttaggaaaacttcaaactgcatactggaaatggctgggctgccagatacaaatacgtgtacatggcgtactgcagggacaagccagacacttctgtggaagcttctagtgaaggacattctgcacatgccgggtgtattcagg

SEQ ID NO: 539 - DNA, 52 bp, Homo sapiens
aaaaataattttaaaggggtgattcaaaggaaggggcaaaaagaaccacgat

SEQ ID NO: 540 - DNA, 33 bp, Homo sapiens
ccacgacatcaaaaatgtgatacatggctggag

SEQ ID NO: 541 - DNA, 271 bp, Homo sapiens
acgggccctctcctaacatttacagaacttgagaagtttcaggcgtgatgaaggcacaaaactacattcgaaaggaaaaaaaaaacatacaaagtgttgatcttcttttaaaaaatcatgtgttaagtgagtgctaacataaaagagattatagctcatacaaaagtataaaaccaaaacaaacttacgaaagaaacaagaaacaaagctacagtttcaaaataaatttcgaattaaaaacatcaacttaatggtgtacctgatgacatat

SEQ ID NO: 542 - DNA, 734 bp, Homo sapiens
atattactgaactgaacttgtcacttgcaacatacatacacatgacatccatggctaggtggggcttctttcgagcttggcatgactatgattcaattcttccactacctttctcaaactgaactgtaaaacttcccatctctcaacatactttaattccacctgtccttattatgctggtgttgtatcatttgtatattacatttaccatggttcattctcatttgtcctattctatccaacagtgtgttcataaatgcagactcaggcaataacattatgtgatcgttttaaattctgtattgaattcagatgatgcagaatattttcatgttaagttgtaaaagatcatgatcaaaccccaaactccaaatttgaaaatccttgcagatgattcccaggcctcaaagaagcggtctggatctacaggcttcagtgggaaacgctgaatctcactggggaaaccttggatacctggaaccttcatctctccccagtacccatcctcggggtcctcacctacaaggtgaggataacacaggttgctggaaagagccacggtgttcagccaggagataggagtgagcagagccagggagcacattaggctcacacactagacgaacactcgctttggacatcagagacttacgttcctgctgtacccaaattaaaaggcaccacttattgtgaactttaaagttatttggaagttcaatcccaaacaatgatgt

SEQ ID NO: 543 - DNA, 172 bp, Homo sapiens
tccagctaaatagcaaccttgggtgagactgggatgttaaatttaaaaacagtaaggctttcctgtacctgtccttttatatcatgcttccaaaaaaaaaaaaaaaatcacacactgcatatgggctaaataatagcagcgatgatgatgataagagcggcaaacacatacg

SEQ ID NO: 544 - DNA, 250 bp, Homo sapiens
cggtggctgggctgcacactgcctctatcctgttcacgaatgctatcagctgtgtctcatccagtgcaatattcacatctatcaataatattctaccttctaattacccactcaagtggaggcaactgaaaccaggtgatacttaaaagtactgaattctgaaatatagtggctttactttcctagttctttttcacccaggttaatattagaatgattgtgttagatgctgtccttaaaatccaggcca

SEQ ID NO: 545 - DNA, 1278 bp, Homo sapiens
cttgaacctgggaggcagagtgagactctgacttgaaaaagaaaatccaggccaaatagcagcaaactaagagggccttgaggctcctgggtgatggggaaagcccgcaggaagacacaaatttgccacagataatccacaaagtgaatactccataagtggtaactaagaatgaagtgtaaaataaaacctctacaactccaagatcacaaaagcaggctataccaagacgggaaattctagttctacataaaatgatacgttaagagacctaagtccctaagaatggggtttttaaacaaaagtgccccctgaacccgatcatactagaacaaatgtgatgctattattttatgaaagttctcattttggggggagacaaacacaaaaggcttaatgattcctaggaatggattgataatacaagattgttttttgagttgctaggcaacactgaaaaacaaatgtcgatgttctgagatcacagcttggttgttctcccatgggcaggaccagtgctacccggccttcctgcactccattggagaacaggagtggtacagagccactgcgatgctgagtccacagtggcaacagacaccaactggcatctccatgaaaagtcacaactgaccgcctggctgccaagatctttggtgagacaaagttttcactgaactgtcatcacacccaaacaagtcccatgctctccgggttctttgctatctgtgatcacttcaatcgctttttttttttgcaggtacattacccccttttcccctaccggtctcattaaagccccattcacccctaagagtgattttgacatctgggaaagtacagacacttttcctgagagttatttctttatttctaagccatagccttgactctgaatatttccactgtaaaaaggcctatttccaataacagctttcttagggatatgttgatattaccttaggtaagttgaattcctcctttgctgaatgccctgaactacggcatctattctttttcaaaaaataaaagatgatgcccaaggttctaaaatcacgtcacacatctacgcacagacttggtaaagaaatgaactcccttctttcattctaatgtttgggggcacagtgtagtactgtttatccctataatccaatcacccacctcagtattccaatctgggttacttcacctagtcatgtggcttgtgatatatagagacaaagataagctaatattgtaataatgatttcactgaagactattttttaaagagca

SEQ ID NO: 546 - DNA, 851 bp, Homo sapiens
gttcaataatagtttcattttctttacgttgtaaacataattttgtgctttaagaactcccactctttgccgcccttcccccccacccccaattaaaaacccaatgaacctgaaaaacaatcttagatctgtgttttaaatgagtctccaccttcaagggcaagttgtccgtcacttaggtaaaaggactaattaaatgagcttgtcatagccgtaacattcaccgtctgaagtgcagacgaatctactacaggccaattgtgagtgggtattcctgagagcctgacacgaatgcatcgtacgtggtaagaggctggttcagtaaccaccatttctatagcaacccccacacactctcaggctgtgttttgaagaggcagtgaaaactggattctacaatgtagcttcactcttagaatatgcttttatttctatcatctcattagaatgagagtatccaaatcatataatccaggttgccattaaacaggagaaacttatcaaatacaggatccgtaaatctttatttattctttttgccacttgatgtccatcgctttaaattcaaaccactgacctggtttgcctgtgaccattccccagggcaacaagtcagatgtccgtctgacaacctgtacatcagacagccatctgctgccccagttacaggataaagaaagggtaaacgtctgtaaaatagagctgacataatcatctcttactgtccagaaaggctcagctaagaggcattcgctatgactaacaaaacttcctttgacagacatgggaaggaaaactgcttctttcaaaggtcaaattggccactgcacaataaatattcactttattta

SEQ ID NO: 547 - DNA, 208 bp, Homo sapiens
acaaattcattttaacccattcccctcacatacatcttgacacccgggacacagagagggcacaattggatcattacatattccgctgattctttaaggaaaagagatccactaaatagagtgctccttcgctctacgaatcacagcattttaacaaaatagctttaacaaaacatgtcaatgtgacaaaagtctcgattccagtatg

SEQ ID NO: 548 - DNA, 37 bp, Homo sapiens
atatatgcaagtcgtgcttcttaaaaaatttatttta

SEQ ID NO: 549 - DNA, 401 bp, Homo sapiens
cacacacacacataaaattatttttattgagggtccatatagcaattagccaactcatgctgttgtaacatgctaaacaaattcaatgttatttgtattctaagatggtgttaatctagttgatcaccttctaatgaatatataggttgaaatatgaagatgccaatttcaagaatgggaaattctttgcttgttccaaaagaaaaaaattaaaagacaactgtgaaaaacggcagcatcaaaaattgatcccactctcacggggtttgaaagagagcatctctagttctctctcctaagagtaaactttcaatttcctggcagtcaaggattaaagtgtgtgagttagagttaaaacatggatatactgagttagtgttaaaacgtgattttgaggcagg

SEQ ID NO: 550 - DNA, 282 bp, Homo sapiens
aactaccatgtgattgtatcatttgaacagaagtcccatcaaaccataaaataatttcatctttctttacagagtttgaggtctggccctacaatgaaggtgctgtcactctgagtatcagttgtcaactctggcaaaatacaggggagctgtcagctaacaggaaatatggacattggggctgtctgggcaccccagtttgctcctgtagagtgtggaatacactggcactgtaatattagaatggaaagaacttctggaaggcatttagaccagaggtca

SEQ ID NO: 551 - DNA, 258 bp, Homo sapiens
acagttggccaaacccaatttagatgaaaaattattaatagattcacaagttgctatctgtgccatttctggctgttaaacaatttggaattggcagttattttgatttacctcaaaaatagataatttaaagtattaaactatttgagatgatcgattactgtaatcataaatagcagctaattattaaattgttttatgtgcttaagatgtgttggcccattccccatttttttcctgatctaataccgtctttag

SEQ ID NO: 552 - DNA, 286 bp, Homo sapiens
taactaaaatattttaatttctacttagataatattacaattaatgtaatagcaacaaaagtcttatgaaatatgcaggcttctattgagtataataagtgaaaaaacatatggtttctttgaaatgtccatcttaaagttttcagaaaacattttaattcatttggttatttttgaatgactatccacaaacgttggcttttttctgcatacatgcaatctgttacaaccaggaatttggcagttacatttttcatagtaaatgtgaagttaaaaagaccatttc

SEQ ID NO: 553 - DNA, 147 bp, Homo sapiens
ggaagcggaaataggtcaacttcacaatgaagattcccaatgtactgtcatggttattttttcagagaggaaacagagaatgggctaacttatatttcagaggcttcctaacaatgcacacacctctgttttcaccaatttctgtat

SEQ ID NO: 554 - DNA, 399 bp, Homo sapiens
agttccatctgccatggacatcaaaaacttctttaagtttgttatttgtgaactgtatataaagtccaccgaggaaagcaaggatgctgctttcatacacctgtgccatatagttacagtgcacacaacccatacaggaatccctagggaaggcttccttatattaggagccccagccttattcctccatattcaaatatactcattaaaaaagagaaggcaaaaatgagaagcaaaaaataaacagcagggatggaggctccaagatagaaaaaaaatccaatagaactgtcctccctctaaacaagagcttaaacatcatccttttataacgtgtacatatacatatatacataaaggtaaattctatgtatacagtcaatgtatacattgactgag

SEQ ID NO: 555 - DNA, 40 bp, Homo sapiens
atcagagtatcttaaattgccttttaaagatatctaaatt

SEQ ID NO: 556 - DNA, 21 bp, Homo sapiens
ccctaaaattattctcatgtg

SEQ ID NO: 557 - DNA, 302 bp, Homo sapiens
attgatcacaagcattcagaataaatagacttggtgagggcatagggagtaactggtacccacacagacttggtgaaggtgcagggagtggctggtacctgcacagactcggtgagggtgcagggagtaacaggtccccgcacagactcagggagggcacagggagtaactggcacccgcataccgtgccgttcaagctgataggaccattgcaacgtgcacaatgtgctcaggatgaggccggggaggagactggaaaggatcggctgtgctcgtgaaagtgacaagctgtcatttacttt

SEQ ID NO: 558 - DNA, 55 bp, Homo sapiens
gactggggaggtattttgtttagaagagataaactgttcagccagttgactttgc

SEQ ID NO: 559 - DNA, 533 bp, Homo sapiens
acatattttctactgactgatttggaaggaagacttgatccaacatgtttaccaggaaattatgtttttaattacccctcaaacaggcttacagattataggtcaaactaagggaaagaaacatttatccgataatttaaaaaatgggtgcttaccatgagatctggaaaaccaacaactattgtagcataatttttctcatctgagagaattctgttgggagaggcaatcttttgttccacagctgaacttagatgttcagatgatagttgatcactggaaattttatgaggtatgctgaactctgtttctgaaaagtacaaacattagacaccatatgctcctgaaatgctccaggaattaattttttgcaagattttattctcaacaagtcaaatggaaaagaacaagttaaaaaagagaaaacattttaaattacattcatgggcttttgtttgaaaaaatgctgtttttataatcaaggcatcttcccaaagtgatttcaagtatttacagaattcaaaattttatta

SEQ ID NO: 560 - DNA, 1802 bp, Homo sapiens
gctccctgtagaaaagatgtaaaaactgacccaaccaagggttggcaatggtatgttttagatttttttcgtaagtactattcatcccccaaaactgtgataaattaaatagaaatcccaatagtctgcagaaaaaagatgttatcctaaattagacttgcaacctaaatgtatataaaaatactgatctgtcagttaaaaaaattcaaggacagagcttacaacagtgaacttccttatgacaatttgagatactagattcttatttactatttctggtgtagtgactaagttttttcttttggtgtaaacttaacataggctggtgttttgttcttaaatgattctagaagacagtatatgtacaagcatgcactcacacagccataaacacagatgacatagtatttaccttgtgtaactccaaaccctgtgctgggcggctcctctttcagcacatacaactggcaaaccccactaccctcagattcgatgtgtgcaggcttagttaaaagatatttcctgcaaacaaacaaaacatctagcttaagtgaaatttttctttttctaatagtaataaggccagactaagaaaaattagattctcctcagtctcttttttatagttccagtataatttgcagttttagagtttcatcatgaattaacaaataacttctcaacactgtgttaaagagcagtgcacaacagcaatacagtaatgaatgtgaggcaaaaatccaatgcttcctataagagaaagggttgtggggaggggaagcaactctaatggggtgcactcttattatcatgtaaccctctcttgataaaactctttgatcagccaggaagggggagtatgacttctgatttgtgatcagctaggagatagatgccctcacaactgtagtctccttgatctacttatttttaacatttctaaaatatggatgtatatataggcagaaatcctctgcaatgagatacttctgcttgtcagcagaggggcagaaagagtctgcacttagctagtggagttgtgcatgagggaaggtgctcaaagtcgacaccgcctttcatcaagaactgcacagtccaatgggtcagataacataaacataaacataaccacatccaaaccagaatacacaagataaaaagagaaagacacttctaaggtgtgaactctgtgaatttacaaagaggcaacagctctaggatagagactgtggctctttgaagggaaaatctactttgaagtgtctccagtttagcaagaatacagtgaattctcaatgtacaaataggaaaaagcccaaataaatatggatcatatgaaaaagtcatgattttttaactgttaatttcaatgtcattttctgagaagtgacatttattttttctcccctcctcaattcttataagtctcatatatagagatgctgccaaacacagaaattgttaaaggacagacacaggaaagacagaacagtaaagatgttggataattcataaataagattgagctacaacatactccatgatacactatataaagccactcactgatttgttttgctctccaccagaagccatttgtcctctgctacaaggaaaactgtcttgaggttgatgggaagtgagatggtgtgagttcgcccttctagaacatccagcacagtcaggctgttcctggaaaagaagaaaactgtatctgaaaggaaatggtgaggataatggttgagtaatctggcataatcatttcatgatacattatgcaacccataaaaagaatgttttaa

SEQ ID NO: 561 - DNA, 2176 bp, Homo sapiens
taaaaaaacagatatgcaaaattctaaactatgtcagggtgtgtataagtaaaaataatggaaagtagtaaccattgccatgttagtagtggctatgtcatggaattgtgagcactagcttttcttatatctgtttctcaatattctgcaatgtgggcaagttactttatattaaaacattcataatttggttacattcactttatagtaaacaagtataatcaaaataggaaatagaatgggccaaataagaactccagtttaaatcctctataataaagagctcaccctttttctttgtagaacaccagccagtttttgtgtgaaaattctttacacattttataagtttcctaaagacaaacaaaacaagatattcatattaaatgtgtcagatacagtcatgtccctctttagctacttccccttaaataaaataaagttcttcaactagtaaaacatgtaattctcaaacaagctatctatttatctgctctaagactcttatggtaaaatggattaaactatatatcaaaatttactgtgaactttgtactaaagcctcttcagaataaatttttaaaaacaacaccaaacattgttaagaaataacaggctatctgatgattaaccatggaatttacaccataaaataaacacatgggaaacactttgtttcttatattaggatacatttatgacattaaaaaaaatcactcttttcatagtcttttaagacctaagtatgttgacttgcagggcagagggtaaaccttattttaaatccattatttttttctgaatggcagaataaattctcttgtgttggcctaaactatttacttactagtttaatttagttaataaactaaaacacttatttgtctaatggaggaaattaggtatcatactcacagtttcatcatataaatccaaaacataactacataactggaaaacaggttaaattgactccatgatcagaaatttgttaaaaatacgatattcaaatagtttttaattttctcttattgttagtccagtcctggcaaatcttcatgcaagtataatgtcataaaaagaatttattgatatttaattatacacatatctatggttatatatatcatgttaaaatctatacgtgcataacaggaaattctcttgtgcattacaacaaaaaaggcacttaaagggatgggcatgcatgcatctttctggttagaaagctatagaaatccttggcaatttgtgggacaaatgtggtgtttcttacagcttcttctttgttccaccagaaaggtttcttagatgtaaacttctcggaagggaggatgagacgatgaagggcccggccagtagtatctaacaacaggataacattactctgcaaatgataaaaacagtgaaaagctcaagatttgttctttttttttttttttttaaagcagcaacctcttggcaacctgacagtgaaggttatagtgataaatcaaaacaaagacaatattgtaatacttaagaaatatcacaaagacattaagtgatttttcttaagaatcacaaagaattaagtgcttcttaatttaagaatttaaaatttttggtggttttatgaagacgtttctaaatatgtgatgcagaaggtattctctttaaatatttttatgtaaaaaccattcccttttaaatataagctagttgaaccatgattctgttttattatctagttataaggaaattacaaggattgatgattttaagaaattcatctacctgtaacaaaattatacttagagaatgctcagttgaaagctctcttatattgtgcataattaaatctcatttatctttttcacaaatccaggttcaatttagaaaataggtataaaatagatataaagaggactaagcaagaaatatgaaggactccaagaaactagctagtaatgaatgttccttcatttagaaattcaccaagcttgaagaaccttcataactggtgctgtaataaagtacaaacaacagatttctgcagcattattaatcacagctatgcaatgatgtaatctttcagtaattaggatacgtttttttaagaaaataaataaaccttatgtgttgaaataaatgaactgaaatacatgaaataaaaacttaacattgagaaagccag

SEQ ID NO: 562 - DNA, 289 bp, Homo sapiens
atgcaaagaagttggctttttagttaaaatataaagaattttgaagattagactaacaggtttgcagaaaggtacctgcaagttatttgtcagacctcattgttatgcgggtgtcttttctttctttgttttattttattttaaatgtggggctcctccagttatcctaactcttgtgaacttttcatttcaagaagaatttcttttggagaaaataaagtcacaaagcacatgaagaattaataaaaaccttgaaaaatatagaaaacaataaaatgtgaagtgtttg

SEQ ID NO: 563 - DNA, 349 bp, Homo sapiens
tgaatgattcatctgcaaatctagcatctcagtgtgggtttaattttattttacaagctaattttgtggaagtgttcaagaattaaaatagtatttgcaccatataactcacttcacaccatatactctgaattttatttgtattaaaaaattttactaagcatgttaaccaagcttaaatttctttcataaacatcacccttagaatgtatcattctgtataagatataattctccattaagaatgtgtgttagaaatattcttttaaaaattaacatataagaagtgtcattcaccactacttgacagttttgaaaatggtaatgatatcttagagttttccttaag

SEQ ID NO: 564 - DNA, 1975 bp, Homo sapiens
ctctattctagattaaatattttttgaatgagtactttttgatggaaaaaatatttcttgtataataaatatgtacaacgttaaaatgaattcttagcacttaagcaatttgggataatattagcctttgtaagcaaaggaagtcctaaaaatgtttcatgcccaaaaatgagtaagcataagaataagcagttgattaaacaaatatgatcaagcagaaaaagaagttagtatcgtcttccattttcctacctttttagggtctaatacttacatattcataacatggcataagtgaactgaaaaactgtatctttctaagtgacagaaaacatgtatttccagccactgctgtatttagaattagtttataagcaattggcaacatgaaggagttctgttgctccatccttttagatgttaatggtttccttctgtaaatgactaatgatagattctgtctgggtttaaaaatagaattttgcgtcacacatgagtacatgtaactgtggctttggcactcctttaaggggggcagggaggagacgcgagtgagcaattttattatgtttgtatttaactgggagaaaagtaacctctggatgacctcaatgtccctaaatctgaaattctaaactttgtacagatgtaataaataatctcatggggagtgggggaaggggagggtctttatttttaggcatggcaaagtttccctttccttacttaagattttattttagcaaggaatttttgaacaacttcttaaactaaccagggacatgcatctgagcaaagctttatgttaaaaaggcaaggaatagccgaattcatggaagtacttctctataatattttgcttcattttcagttagggtagaatgaagaagaaggaattgatggcagtctacttatttttcattccactagaattatttatcagttgttaaatttcacagctgtgtgctgttcacatggaattttacaggtctgacatcttgacagaggtatattgtaaaataagatactctctccgggaaaagagaaggcagtttagaggacaggtagagaggaagtatacagataaggtgtgcaggtctgctcagggttccgaagcagtttcctggaaaacttgaaactgtggccaaaggggtaagtaaggcagtatatgaggaggcaagatgctggctatggaagtcaagcacagcttcacaatgaaaatcagattttctttcatgaaagtaattgaaattaaataaggtattaatcagcaatgttaccaaataattggatcttttgaggaaataaaactcttgctgagaacctacaaatctggcacttttattaaagaatttgtgtatgtaaatttgacagttaatttgacagctgaaaatgtggcaggactgttaaaataaatattccaaatgtagtctcatccaattttgactgatttactaaattacaaaccaccaagatatcatgtaccttttatgacacattgttttggttatagagttaaattcaatggcatcaatactttgttgaaaatctttaaagtaaaaccctcattccaattttcaggagataaagttttataaacaatatctggatgtttataaattctgctcctaggagaaagtaaaagtaaaaataaaaaagtgaaaacaaaatcagaaaaatacttataactcagaatttgtgataatttctggtggcaaggactaaagttaaagttgacttatttcctcaatgaactactgatatattatgcaatacttttctcttgattagtgaaagtattatttcttggtagcactttgctctttaaatattcataagtaacaacactgcatttaaaaaatattttcctattatgagtactttttaattttcaaactaatctttttccccaaatctgtagtgagtgagagagtaggtgatgtttaattctggtagggtcaatccaatatgctat

SEQ ID NO: 565 - DNA, 422 bp, Homo sapiens
atatgcttagtgtagtacttggtatatactagatagataataggtatacaaaaacattaggctcctttctattggtattgtatagattaacttagacctttagaatgatcactaattgaagcacaatctgtcttctgatatatgtgttttgtttggaattatttttagcctgactccgggcatctgtgcttgtcactagtacaatcttagtgtactaatccatagtaaatgacggatagaacttgagcatcattagatactgatggatctcactgtattccctttggtgtatttacatgactgtctctaccaaaaaacgtcattcgggtctcagataaaatgtcgtctcctaaaaggaaatatctcagcactctttttaataccattcacctcaattcctcctaccccatctacatcactcc

SEQ ID NO: 566 - DNA, 652 bp, Homo sapiens
acttacctgtttctagaggtataggtcatgttgaagtctctagagaaaagaagatattagcctgcctttgtagtactgataaaatgcaactcctgacccatccctccagctcctctccttgatcatcatgaaagcacatcttttcagttataggtttctaatcactcttgcctttcatgtaagtcattcctcacataattgtagcctggtgtgcattacctgctgctcatggagaaccacttgacctttgagaggacttcccagcggtgccactgtcacaaaagggtgccaaacgccattggctgttcttgggaagatatcaaaaaagtccacaaagaagccacttttcccagtcatattcataaagtacagggaagcgggattgcatgtaactacatagagagtattttgctcattttctgaaatgacaaaaaggtgttaattttgtggctggcaaccaattctctaattggccaagaggtctagtgaaaactgaatcatgaatacacagctggaacagagttggaactcagcagatgatttgtatcatggcttgattaggctgaaaagaccatgagaaacaacttagttttgaccctaaatgtagataaggtcacacctacctacttgaaaaaattggttatctatttgt

SEQ ID NO: 567 - DNA, 49 bp, Homo sapiens
gtcttttcaatctgggtacctaagtccatttccttccatttgaagaagt

SEQ ID NO: 568 - DNA, 121 bp, Homo sapiens
ctctggactaagtttctcataatctcttatgtgggcaccgctgaagcaagggattaagctacttttgcataatgaatggtatcagcatcacctatcacccaggtatctattttacaacagt

SEQ ID NO: 569 - DNA, 27 bp, Homo sapiens
tgtgtctgtgtgtgtatgcatcatatc

SEQ ID NO: 570 - DNA, 1976 bp, Homo sapiens
catatcacacatattatatataaagatacagtaaatttaaataaataagtgaactgataagaaacacaagtcaacagaaggactgaaaaagacctatttttttaggagacaatgcaaactgtagatgttagtttcaattatcagatagaaccacagaatttataatttatggatctttcataatgcttccattatcaacacaaataagttctattcaacatttatggcataatatagggcactgggaatacagtaaaagtgttaacagaaatgtacttaataaactctttaactgttttctctttttgcaggcattaaatgcagttcagtctttgtcttaaacatacagatacaagatttatatttatcttttaccaatttaagaaaaactgtaaatttttaaaagcacatatttttatttaaaatagcagatttgtggaataaactacatcaatagaacttataggcataaagacaagataccaatttttgtctcaacaattctcatcttatcaagttagagactctctcccttcccccagccaccacttctgtttttatcaccttagtaactgacagcagttgaggaacttctgccaaaatgtacccagggtccactgcatgaatcagtaggtaatggcaacagtccagaagtgtggatgccaaaaattcacattctttatttgccatcctttacaattagaagtttaatgactgcaaatcactccagccctactttcatggttcatgtaatcaccaaactggaatcccagccaaaaaacccaatgtttctcctttttatttttcccttctatttttagcacatgcctgggtgtgtttaactttgtgctacaattgtaatgagaaacagacatatgcatacaaactcaggagtgcttatgtggattccacaatagcatttttttaggttgttagaggaaattagttctaaattacatataattgctatccaatccaagaatgacagacaccaagtctatcataaactttttgatgtctagagattattttaatccatcttttaaaaaaacatgtgcaggaaggaaagatcaaaagaataagcagacataccatgtgatgtagcaatgtcacagattatattaatttcatccaatggtattctccatgaggcacattcttcagtaaagtttagggatctttcttcatgtctttctattggatactcctgtatatttataagtgctggaccctataataaagcagttatctcagttaagatattttggttgtcaccaaaatgtagaaaagctaaagttcttccaaaatataaactttaacattcaagtatttaatatcctgctataccttttttcaatttattgacaggcttagtactcataacagtaatagtatcacacacttgcacttataaatgctttcacatgtgctatcttatttaatttctcattttttctttttactcacaaaatataccagatgtaaaatcctatagcatttctcatttcttcattccttcctaaggcgagagccagttttgaactccaagtatcaggacgcagagctgtccaaaccaggagaataattcgcaaatgaatgagccagagcctgatgcatttccattgtgaagaaggatttttatgtcattacacagaaatgtaatggttaaacctgggtattttaaattaaatgcaaaacatgtggcatttgaaattttttaaaaaaccaaacttactgataaccactagtggtgacttatgaaggatagagtatttcacacatggtgataattattcaatataaatataagcagaggagctaatttaataatgttaagaatattagttctgggtacttagatatgacttcttgaaagaatgctataaatgtaagcaaaaaccagtgatttgcatgccctacagtccttaattaatcaaaaatgtttggactagatattggcatccatgtcccccgcc

SEQ ID NO: 571 - DNA, 72 bp, Homo sapiens
acaaggaggctctgacaaaaatgaacagttggattaccacatgtctgggtgtgtttcactttgtcctactgt

SEQ ID NO: 572 - DNA, 74 bp, Homo sapiens
actgctctactgtgctgccctcagcagcagggatgacagcagaagcagaaatactgatcttgaaattacaagtc

SEQ ID NO: 573 - DNA, 879 bp, Homo sapiens
tgcttgaaatacctagagggacttctattacaactagtaacggacagttctttactttactttcacatgaagactgaacctggcaacaatgtgtggctaaaaagaggccaaaaatcaaaatgcacaaagttttaatcctatcagcacaagacaaataccacagagcaactttcctaggaaaatatgtaacatacctgactctcatcatccaattagctctttagaaattctatttagcctttaggaattatcaactgagaggccagcctgatttgaaagttagagcagaagctaaaataacatccgaacaaatcatttctgagattgtttgaattatctccagggaagatacagcaaaatttataaggttcaatattttaagagagaataatgatgatatcaacctttatgtctatatgatgagtttccactggacacaagagtttttgcatcccacttcttgcctgaccaattgtccagtagcccatgaacgtttgttctggcagagtcaacctgttaaggatgatttgcaaagtaaatatttcttattgtacccaagtcatagaaaaaaataacacggcatctattatcaaccacacaaataaatttgaagagtgctttacttagaagtgagttatacatcattttattaaacgacagtgtataaaatcatgtttaaaatatactttaagacaaaaaagatctcgcatttcagaaactaagaaggtaaggcaaggtcctgtttttaccttaatgacaaatacaattgatttacatacatactcctttgaattgcagtaattgaacatctaaatttctggtagagtataggaaaacttttctttaaaattggagcaatctatcaattttttcagtcta

SEQ ID NO: 574 - DNA, 127 bp, Homo sapiens
atgagccaccgtgcccagacaattcttttaaatttggaatcaaataatgaagagtacaccatactactagtcccacatttgtatgttgtatagggcaagtttcatagactttattttggcatcttaa

SEQ ID NO: 575 - DNA, 124 bp, Homo sapiens
gatggaatcattctgtatttagattcccttttatttaaaatgactttcaaataaggtgatttgccaaaaccaacatggcaatactaaagtataaaacagcagataattttttttaagtcttcac

SEQ ID NO: 576 - DNA, 183 bp, Homo sapiens
agtcttcactttttaatcatactatcttttatttgagtctttaaaataggaaccattgatttgtcatttaatgcattagaaaattagtgattcagagttaaaagctctttaaaaataatatgcacatggctacaaattgaaatgtatccttggaatgagtttgatgatcattaaaagaacacg

SEQ ID NO: 577 - DNA, 597 bp, Homo sapiens
gtaaaaagtagtctgacataatatttccatatgcttaataagatcatgtaaggctaagatattttttgcataaaataatggaagcaaacattctagtagaatatgcttttcgtcccttttgaatgctaatgtttatcacaagaggaacgaaattaaaaagaaatttacattgaaattcttctaagtcatatgacataaacctctcaaaagcacacacacacttttgaatctatcatctaaaatatattttaagtatctgtacaattatctcaatcggggacccacttacttccatctttttaccaggaaagaatgtgtgtgtgcagggggtcgggggagggtactgaattaggggaataaagggttttacaattactgtgttctctcttttgaatgtaataaaaatacatttctgtgttaataggccagatcttgaaaacatagactgggatctctctcttggtttagggaataaactatattttacatttgctttcagcagttcaccaaaggagaattggggctccaaatgtagaaacagaaaaataacagaaggagatacacttaatattctgccagcatagaagacataatgta

SEQ ID NO: 578 - DNA, 206 bp, Homo sapiens
ccttacagcttggggagtctgtgaggatcaaggaagagagtagagagaagtgtcactggtaagttttatagtcttgcattgtcttgatactctgaagtgaaaataaataatcagaatgaaaatatctatagttaccaacagaacagatcccctgatagatacacatgctttattaaagcatataaaaacaagctctgaatacatcc

SEQ ID NO: 579 - DNA, 873 bp, Homo sapiens
tgttagtgacattctgttagctctcatgcagttactcatgaataatgctatttctcaggaaggttttcaagttgtctttgagaggcgtcccaacaaagtatatttagcaaaaattcttcaaagctgtttgcgtgtcactagcgctcttcattaatttctcctgacgtggggttttcaatatgtaaaggttttgactacttaaataattttaatggtcacctggcaaagactgagttagagatgcccatagtcatgcagcccagaagtcaggactatatttctaggctgcacctggatgaagttgtcctctcttggacactgacaccatgtcttgagtgatgagccattcatgatgtgctaagaaagagtaactggcactttgctgctctcctgtgacatgtagacgttccttgactcggctgttctcacccttcccctctctttgctctgcactcttgccttagttgacacatcttcctttggcttgggctgtccctctattcagatgaccacaaaaatacatatacagatagccatataaacatgaaaccctatctagtcctcaccttgctcctgaactccaaattcaggttttgaaaactttaaacatcgtgcttgatatttttacataggtgtcccaatagtgagaaaacatactataacatccaaagcaaacatctgctttcttcacaagtctgtcctcttcctgtgtctctttctgtcctccagggcttgaaaacctcccatttcccttccctcgcattcagtgtcacttgtctttttgtcctacctccaaattgcttcttgaatttgtctcattctttccattttcatttcaattacgctggctcaggtgcctatcacttctcaccc

SEQ ID NO: 580 - DNA, 85 bp, Homo sapiens
tgaaactttctcctccatggctacaaaacttcctaaagaagatagaaccagctctcagctcatgcctgagaccacacagtgtcat

SEQ ID NO: 581 - DNA, 974 bp, Homo sapiens
aagcactatttatctgaacaaaagcttattttgaaacaccacaggggaaaaaaggaacataattgtttgttcatggagataccatgctagccaaagcaatcagagaaaggttaatttagtttagcctgagaatgaaattatgattatagatcagaaaaacattggagagaagatatgattaaaatcaagtggttttttgtaagaatggatgttttcttttgttagagcatgcatggtgcaataagagattgagattctgaaccaagtataattgaagtatttatggactgatgagaagattcatgcaatcgattcacaaaagggaaaaggttcaataactcaaagaagccaaggaaagtcaccggtgatagctatcttaatcgagaggaaagacatgtactgcaacataggcacatgttaaagcagacattaacatgggtggcaacagcatttcctgctcctcaaatcccacctggaatcaatgagtgggcctgaggctgtgctttggaaagtcatctcaagtgatgatttgctagttcctggccaaactttgtgccgttcaccaaggaaacacccatggttacttggattacatagcaacctcaaaacagctggaagatattagtcaactggagccacacaggactggcagaagatggcaaaatgggaccaaatcaaaggttccttgctttgttttcaatctaaagttccatattctacacaaggccgtgtccatgcttggtgagtagctaggttttaaactagccctatcttcctaaatggaggactagaaggcccacctgagaataactcccctatggattaaaaatagattcaataaggaaaacacttgaaaaatgctgtgttggcatttggataatgatgcaaaatgttttatgagtatatgtaagcatatgctttttatggaattgttgagttggaaaaagagaaaagagaccctaacaaacaataat

SEQ ID NO: 582 - DNA, 178 bp, Homo sapiens
aagtacaatgaaggtaacaatgaagtgaatccttctatagagaatgctgcatgctaggcattgtttaagcatatcatctgagttcttcactaacatactggtatctgtcattcccattttacagaacccaggctgtctggctgcagagaatgacaataatgatggaggtgatcttggt

SEQ ID NO: 583 - DNA, 103 bp, Homo sapiens
agataataaaaactcccctgaaataattactctcattgaggatatttagtaagttattgactccaacccccttaaggatttttaaaaaatgggtgctactttg

SEQ ID NO: 584 - DNA, 97 bp, Homo sapiens
tgctaactctaattctaaccaaggcttcatttgtgtgtgattgtgagaagtcagagcagtggacctgacttttcatcttttggctgattgtataaac

SEQ ID NO: 585 - DNA, 85 bp, Homo sapiens
ccaattaagacatcaactaataccagatgaggaatctgataccttcaattaaaaatgtattcttatatccctttgtagcactgtg

SEQ ID NO: 586 - DNA, 57 bp, Homo sapiens
catttcgtctcatagcattgtgtgcaaaattctctacagaactcaggaaatttagtt

SEQ ID NO: 587 - DNA, 1408 bp, Homo sapiens
ccatactcattctcaagtcttaggataggcaccatctcccattactctcacctcctctgaatcatccattttggcccttagccaactattgccttaccctgaagctcagagccaacctggcagtgtcctggtgctctcaatgtccagggaaaggaacacttgtcaaatgagtgactatgtaagaagatccaatcattcaatatcatgttgttcacatatagtttatataaaatcttatgctgttttatcctaaataactgcatatagattttttttaaagtacatggtttaatttttacatttcttggattttgaaattagacatctgtttaattattataaagatctttcctcctggaaatgacagaacttttattaatctctggatacggattagatcttttgaaaaaataaggcttttccagagttttgggttaaaatggtggattaaaaacggcatcacagaagttctaatccccaatacttagcaaaaataataaaacttcccccagaaggacaattacaaataagaaccaaaaagggaaaggcaatcaccttgaaatacttcatggaaaagaaacacaagattccagagtagaatggagaaacagggcacagcttggctcccaaccttcttcctttgtcctgaaatgaggctttgctttctctttagacaaaaaatctgattttgtttctgattttaaggaacactcagcccctcctaaattatttgtgcaaactgaccacagagcacaatttctaatttgaaatctccaaacaatagtcatgcttaggaaatactgaagtgtcttaatattttcaggaggagtagcagtaccaacttgttcctcagcattgagagctttgtgaaactgcaaaagggcaggcaatgtgaaagcaaggggagggcagaaagaggaggagacaggggacatacagaatacatacactggatgatcaaaaagaaagccatgggatagtccagttttatgcagacattttcacactgagacattttttcggactggctaattagggttcagataattttctccaagactttaggaatgtgtccaggtttgggcccaggttattttcttggtccataagtagaagattacctgtaaattatccaggatgattcggagggagtgcacctgtcgccgaacagcacctgaaaacctttcataggttgcagcatcgtattcactcatttggatctcctttagcctgaaatcagaagagtataaaaagttaacagcttaaatcacgtatatgtgggtttttacttccattcgcctcctgctggaactttagcaaactccttggaaactcagattcatgttgaggagaaaaggcaagaagtgatgtctccagctgtgcttccagattcaaaggaggtaacatc

SEQ ID NO: 588 - DNA, 287 bp, Homo sapiens
ctatatcccaaagccatattgtgatgtttgcagccgatcagttcatgtggcagattcctaagagggttcccatgggttgctttttaagatcgagatcatgtatttggttgaccaagataacagttcaagcctaaagaatgtaagttaatgtgctgctatgtatccctatgtgagagttttctaaaattgctgacagtgtaatttaaacaggacaattgtattttaatattattgtggctttgaaattctatcttcccagtatgctgctcctttttatcagtttttat

SEQ ID NO: 589 - DNA, 477 bp, Homo sapiens
ctgaaataaaaatacaactcagcattacttaaaatgcagcatcttaaaccgtcagtagaaagttcagagtgaactcccttgggttttacagtgttgtatccataatacattaacttaataatacatttctataaattactataaatataaaaggtactgatattaggacaaggaataataagtgcatatctcaaaagcccaagcatagcataatcttctaaactagtgtgttatgtatatgcatgcaatgttggagatatgaatcctaggtgtattgctgaaactcttatctaatgtgtattttttatcaccttgagctaaaacagaaacctcaaatactgaatgagaataaatgttctgtattcctccctgtcaggttgagcactgggaaaaatccattcaccatgggggagagcgccagaggcttattacaattatgtaatgctaggcctagactaccatggggcagactgacat

SEQ ID NO: 590 - DNA, 69 bp, Homo sapiens
cagacatctaccatgaaactcgcatactttattgctttaatagataggcctgttgccctctgttatggt

SEQ ID NO: 591 - DNA, 774 bp, Homo sapiens
gcactttgaaaacagtgactattaaaaggtaaatacagacaaggccactataatatctgaatggttgtatcttgaggtgacatgccaaggtgcctttctaaatctaattaactctcagtcctgaagaataaaaagaaatatgtgtatagaacttgacctcctgacaatacctcttgtatttagtttctggcagtctctgaaatctctctatgactttttattagattaagttatgtctcaagtatcaaggctgacagaagctgggcacaatgaacaatgcaggacatgccacctaccccttcatacctaaaccggtgtgtgtttatatgtcaatatgcttcttctcaaataagtgagattagcactgattagaaacaaatgtagacacagctgtctgtggggtggggaggggatggaggagagaatatatagaaatatgtgattaaattagcgcattatggatacgactctgtaaaacccaagagaggtcacccagcaaatgaactttctacttacagttagtttaagatgctgcattttaaataatcctgagttgtatttttatttcagccattcaattcattttcagcatccattatatgttaggtaatatgccatatacttctataaatataaaaggtactgatattaggacagggaataatgaacatacgtctcaaaagcctaaccacaacacaatcttctaaactactgtgtgtgtgtgtgtgtgcacgcacacacacatgcaatgttggaggtatgggttgtaggtgt

SEQ ID NO: 592 - DNA, 977 bp, Homo sapiens
tcaaggaaggagctagccatttggtaagccacctcgagcagactgatctttgcagagtgatcagaattagcttcagttataggcctaccactggtgcgatcatgttgcacccaaaacacaccacatgctgttttaattatgaagaaatctggaaaccatattccagattgtgtcggttttcagaaagatcacctacaaggcaatcaaagctgataaattttgaaagatgatgactgaagcaagggatgtagaaagaaaagaaattttagcctctggatcaaatgaggtacccattgctaatactctcaggcccacaaaactagctggaaacatatctttctgcttctttaaccctgatcaaaactgcagggcacagctgcttcacatcctagtaatctttgtggactaactgcattttgttggcacagtatatttttaaaggttatatttattgttacgtaagagtctgggaattttagttctcattttactttttcttataggtcacacttaaatactataattttgaatcaattataaggaaaacaaacataagcttagatccactgtgtgaggctgattagttttgcaaatggtagtggatgcaatctccacagctggtgcctaccctagacgcttttctaagtgtgtacatgtacctcattgtctatttcatttgcttttcactggtataatgtttctgttctattttattcatgttttatgcttgtctctctctgttagtctgcctgagttaatacattcttgatatgtaagggctggtatctagcttaaaaccagatataaacagatgctatcaaaatgctgtgttgatgatgtcaggaacccacttagcagcattaggctctccaaggcactacacaaactttctggctcacagctaggactgcctagtttcagccagtctctgaattaagtactaaaggatgattccattacttgtatgcacgtgtgtg

SEQ ID NO: 593 - DNA, 48 bp, Homo sapiens
gacctcattctgcatatgcctaagtggcaaaaccgttttaaaacctat

SEQ ID NO: 594 - DNA, 795 bp, Homo sapiens
ttttcctcttgaagttggggggtcgggtccatcgcattcattatatgttcctctcaacttttatgtttgaaaagttcctagtaaaaggttgaaaaattttcagcagcattaaatgaaatattcaccaaatgggatgaaagtcccatttctacatgaaagtagaaagcaacatctttctcttggtgttttgctgtgccccatctttctcaggatctccatgtgtttctatttctttctctcctttctcacacgcttggccaactcctctgtctttcaaccaccttacggtattctcttttacttcaactgagactcttctctgcagcatttactagaggtgtacattttcctcatcccttccccatgtcctctctttcctctcttacatccgctaaattcatttgcgttaagggcacagatgccccttacttcttcccctgtagggcaattgtcctgaagagaaccacactccttactcctattatggcaacaggagaagggcgtacatacttgtggccaggcactgttacctttctgcctccctgtgaactatgtgtgtgccagaacactcttatctacctgtccacttgggcaaaaaattagactgaacaattacttggcaggttttaagggtggcaacaacagaactcattaattgcggaggggagaatgacacatttccaattgtttagttctttttctaaatgggtactttataattcataagaaatgcagagaactttcattctaacaagactgttcactacactattctctacccttttttgagaggca

SEQ ID NO: 595 - DNA, 500 bp, Homo sapiens
gagggtctgagctggcaggctttcctgagggtgtggcggcagggcctgcattcttgtctctattgtcctgtactgtttacttgcaggatgtggaagcacagcatgtaatgtaataccagatgttctacgtgggaggaatttcataactcatacattttagcatgcttttttctaactgcgcccatctcctttcatgcagcacaaaaatgtaaatctgtttcccaaactactaccaggtcctggaatctaaaaggaaatactggtggttctttggtatttttcacttttagttgaagcacacatgtggatgtctagggtaacatcatgtggattcttcttattttttaaatggctcctattgtagtggcccagaacagctggggaatgtccgagggccacaggctcactggcctagattaaggcctctactcactgatgaggcctccctatccaaactcactgtccctcctcccgagctggtacccattatcctgagtggg

SEQ ID NO: 596 - DNA, 765 bp, Homo sapiens
agacttacctgaattccctatgttgcctaggaacagatagacatggatggggcgatttgagctttagattttaaggagcctgagtagaaagaacaggtgattttgtttatttggctgtttccgttagggacggggatggctgtggatttcagtttgaggtccgagttgctgcatgaggtggaggtggaaacacacacaaatctaggtttccccacagtccatcatgacatttcaccatagcagtagtgctggtctaaatgtgatgggagcactgacctctgctggaatgctctctggcccatctctctagcagctctcttgacctcttcgggaactgcatctttctcagcctgagagacctggtacaccgtatggcctgcatccagccggtaagggcctcctttgccacccaggcctgccgtgtctcttccccctggaaggaaaacgtggaaattcagatgataaatctgaacttgaccacagaacaaaagttgggtcatggttttaggacagccttgtggaggatattaattgtacttaactagtaattaaacagtcaaattaccttctggaaaaagatgtattctcttgtttaggatgcttttcctttttcccatccattaaaatactacctatatatcaaggcttactccagcttctatgacaccttagctaatgctgctacctcataaggatccatactcttgtgtactatttgttatcctttcatatttatttttctcaccaactatatgatggatgaga

SEQ ID NO: 597 - DNA, 268 bp, Homo sapiens
agccaagattagaagccaattattacaccaactttgacttctggtttgaacaatatataacataaacaccatcagctttagaacagtctttcaatagaaactcaagtttacataatacatattacatatacatattacgttttataacataacattgtatgaactgttcatattgtaaatgcctgtaaggccaggtaggtcatatgataaaaagtggtggggacattggctaacttaggatttaccttgtctaaatacatgaaaattg

SEQ ID NO: 598 - DNA, 141 bp, Homo sapiens
atttaggggtagattagaatactagtaacctgtttcttttgttcattcacgtataacttgagaacttagaagggaatccaatattggaggggcagtatagtataatacactgctattgtagagtatattatgatatagtta

SEQ ID NO: 599 - DNA, 1608 bp, Homo sapiens
attaaacaaagcctagttacacagaattaggcaatttctagttttataaagtggaaaatttgaaggcttttagactttgggtaaattatgttacatttttctttcaccatcaccacccccacctccaccttaccactgagctttaactggtctaacaaaactaaaaccaagaactcaatatgaactgctttccttatgaaagtccaggtaggtcatttccttttgggaaataccatgagaactgcctattaattacactactttaatcttttgattggaacatatttcacttttatttagaaatgggtggtggaaaattccttctgggatgtgtgtgactcccatttcttactcatggccagccaataggcagaggggtacagtaactggacagtgacaatgagctataggaggaaaaggtgtttctgggatctaactcctttcctacaggagggtatcctgagtatgggtggatcatgaatttgagctgaaagcttcctaggtgctgagatgttatcattctggtgaaagggagaaagtggtggaaccatcagaagctggtgtgagtgactggccacctgagtcgcagggccccaggcaaagtcacactggggtggagcaggaggtgctcttcatgatctccacttcccagagcctttaatttgtactatttaaatgaaagtgcttaccagaggttctaagactgcagggcataagcctggacattccaaaccacttcagaagataatggggagggtgggcaagggaggagcattgatgaagaaaggggaatcaaatgacttgttgggccagagctcagttcaaagtaaagaattctgagggaaaagaatggcagagagaaaaagagaaattgaagccaaggagccttgatcaattgaaaactaaaagccaggtgaaacaaatgtagcctcaatctggacagatacgtgagctagtaaattcaagtttggtaacaaataggaatttctcccccagagtagtccactgctgggaaaccacatctggccagctcgtcccacaatgcattccatatggattaaatcttgttggcttgacgctaacttccagatcaaaggacatttctaaaaatagccttactttaaagctgatgcttgatgaataaacagagtaggcaagaagtccacaggcctatttgatagcacattgtctaagcagagaaacccatttcctcccgaggctgtcaaggccaagaggcacagaccatcctaaggaaggtgaagtacagagctcctgccagcactcctcatggtgagataagctcagacagtgcgcacacagtctggccctattcctgtggactcgcagatgtgtctgctccagctgccgcagaggaaaaaggaagacggcagtcctgggaacaatgccctagttgggcagccaagaggaaggagtcggccatcggtttagactgcaaccagccttatctcgaaatcttgcatcctcaacgtacttcgaagatgtggaagacaaggaccatttcttttcagtcagttgctgaagaaagaatttactgtggatttctggcatgatcccaaggtcatggaatttaaaagaagggattaacac

SEQ ID NO: 600 - DNA, 1158 bp, Homo sapiens
ctcttcacatgccttgatgtcacgctggggcagagggcaagacaacaatccaactgagtaatgagggaggctgagaaggaaagcccgtctctgagtcttctcaggggcgatgtgctggcctaatgggcttgggaaacctggggaaggctgactcaggagaatgcctgtgctaccaacctgttccgccagcccaagtgttgccgcccacgtgaggcatgttgtctgggtcctccttcccgtgtttgggggagcttacatcttcaccactgtctctgttgattgttatctaaaaatgaacaattgagacatttttactatcctgtgacaaacaccagggactgcatgacagaaaaaaaaattattttctcctaagtccttaaggtatcacataacctcaggccactggacttgataaatgctgtgagtatttggcaaaaattccatcagatggattccaacatccatctagttgggaagaagaactaattttttaaaaaactcttaaagaaaagtaaaggagctggactgcattatagctacagaatttttctggtgcaaaccaagctgtgagcatttacacatggcatgagacttaccagatgcagggaaaatggatctcactggagaggggtattttgccagtggtttaaaaggatcaccacctagctgatccagctgagtcattatatacacacttacccattctgttttcaaagaaatcccattactctgagagatgccattttacatataatatatggaaaagaaaaacaaaaagttatgtatgtatgccttagtgatagatttatgttatatactaaaaactgcttatttatttttttgacccacttcaatttttattatggtattttgtagctttcctaattcatctttattgtaaaactagatttatgattcctgcaattcaaatagaataagaagtactttagccttcctctgtgagagcctgaagttcattgcttcctatttcattcagtacagtgtcaccaaaaggagtgacaaccacacagaaatttcaatcctagtagtcagttcagtagatactactccacaataaatcaaagcattcacattttatgcacaccatgagcctgctctcagatgcaatgatttcccagaagacaagatcaaattctc

SEQ ID NO: 601 - DNA, 520 bp, Homo sapiens
ctgaagtcagtctttagagttaaccattccatgttggtatatgggattttcattcttgatgttgggattaatgcagttaggtaggtaatttgaggtctttgcaaataaaatggccattcagaataaaatcaagacaacttctactgtcttacgtccaagttggttcatttcaagtgttatgacatcgtagggattttaattagctggacttttctgcaaatagcttcggcaggatcaacaaagtttttgccaaaacttcagcatactccaagaaaatttagcagccagacatgacaattgatataaattccacacacataatcatgctctaaaaatgggtgaaaataatttttcctcctgttttcttaaacaagcaagatagctaggaacatttagagaaaaaaaaaacatttaaaatactttcccaaaaacttgccaccatttttcaactcgtttataaataatgtaagagataagcagtaaattaaaatacatatactggctacaagaattccagaag

SEQ ID NO: 602 - DNA, 152 bp, Homo sapiens
ctcaggcacaagcttgcctcagacctggagatcctgtttagagatctttgcagcaccctctagatgtactccatgagaaatgagaaggacaaagaacatttcaaaactggtacagttttattctgttgctaatttaataaatctatatgagt

SEQ ID NO: 603 - DNA, 99 bp, Homo sapiens
gcgaaaaacaaaacaaaacaaaaaaactatatgaaaggtatgattacagtctaaatttttttaaaacaaacagaatggaacttacatatggagatacta

SEQ ID NO: 604 - DNA, 77 bp, Homo sapiens
aagatacatttttttttaaataataagaagatactttattttttaatcataaagacacaatttatttttacttttta

SEQ ID NO: 605 - DNA, 181 bp, Homo sapiens
tgtaagtcaaggagcatttgtagtttgcttatatgcgttaagactcttctgtaggccaattctaaaagagaagttccaaaaatagtctaaacaattggaagaaccattctgaacaccattcctcactttgtggggcatgtgtgtgtattctggtacactatttaaaaataaattttaaaaa

SEQ ID NO: 606 - DNA, 230 bp, Homo sapiens
gtggttggaaagaaaatgattagtagatagagagaaagaggtttagtgtagaggcatagggtggaaactttaggagtatacattagtgagaacatctttgaatcctgtatgattaccaaacagaaagcagccaccattaacaacgaagaagataaaataactcgaaaagttgatgtcaacaaaccttcatcagaattggcacaataagtccacaagtccatcactcatat

SEQ ID NO: 607 - DNA, 458 bp, Homo sapiens
aacactgacccaaggttatacaacagcacatgaaggagcagcacaaaatgaggtcagaggagggaagaaaagatggatttcagaacagatgattagctttagaaattaggagatatttcctccattctgaaagtgggaaaaagaaaaacgtgtgaatgaaattgcagatactatagttttgttaaatatgattttactgtatgtttgaatttatgtaaatattttaatgaatgaatattataaagaattttaatactttgtagtgttccatggcatataacaatatgagttttaaaatatctttgaaaagattaataaattagcagagtttaatcccaaattgacagtattattttcaattttagaattgcaatagggttgattaccactaaaagaactagcaagaaaaaaagtcttctataagtggagaataaatcaacactataagaatttgttga

SEQ ID NO: 608 - DNA, 630 bp, Homo sapiens
aaaaattttatactatgtattatgagcctagcacagtgttagaggtataaaaagagataaaatacagactcaatgattaagactaagcaagaagttctgctcaacataaaatatataaagattaaacaaatctgaaatagattgtgggatcgttaaaatattgtatacagaaattcaaaatgtctttaaaaattgctgttataaataactataaatgaatgtgaggattaagatgtcaaatctagatgctatacatggtatcttggaataagaagttatatttaatgtctgtgactagttttcatttagccagacttcagtagattcaaaatatttatttaactttcttatttaaatgacttataagtcaatttattaagttgaaagactgaaaggaagtttgatttttaaatgttattacttagagttcataaaaaaatatggagttaatatacatttttatttaatttgcttaatttgctcataagagatttattgctctataatattgaaagcttcctgagcaattgattaacatttgcttgtctttcagtggttttctttcaaaataggtgacaatgattttttaagaatcctctaatttattccctaatttattcatctttgttt

SEQ ID NO: 609 - DNA, 277 bp, Homo sapiens
tttgcctccttgccagagtacaaagtgaaaatattttaccaaataacttcacagtgaatatttatcccatatttctcatatatttaaaaatcttttcatgagctcaagattctaaaatagagttaactagataatattcaaaacagttaaaatgaaaagaaaattacttggcaaaaatccagctattttattttcttggaaatattgaggacattttggtaatcttagatcttcattgtagttcttgattgttcaaaagtatttacatatgtcattt

SEQ ID NO: 610 - DNA, 24 bp, Homo sapiens
gttggacaatttgatattcccaag

SEQ ID NO: 611 - DNA, 34 bp, Homo sapiens
actttccaactgcaatgtaggcagaggttcccaa

SEQ ID NO: 612 - DNA, 298 bp, Homo sapiens
gtttctgggttactctgccttgaacattgtcatctcttgctgtatttaggatgacagttttccacttctactgttcccgtgcatccttatgagaaaactttctgttggtgtaagtctggagtctgagaaaggactcaagtctttaacattatcaatttggaatttgaaatttctttgaccatgtagttttcttaaatatttagtaggtatatgacctagttgttttagaatcatgcatctagatgtatctgtgaaggtttcttttttttttttaatctctcatagagatttaattttt

SEQ ID NO: 613 - DNA, 35 bp, Homo sapiens
gctgagcatggtgggcatacttaggaggctgaagt

SEQ ID NO: 614 - DNA, 29 bp, Homo sapiens
gtattagatagtgaggcaatattacaaaa

SEQ ID NO: 615 - DNA, 388 bp, Homo sapiens
tcattccactctgtatttatttacaagcaaacagattaaaaacattttaggaaccctcaccaccctgtgaactgtatttgcatgagcctgctgtatagatccattctaggaaattaaaaactagagtctgagaagtgttctagaaatgggttttcgactcttgaaattcctgtttttccaaatttattaatgtttttgtgctgattttaataaagttcttttaattcagatatttgaaagtatacccttgactactggggaggccactgccccaattgaccttctgggagcatctaaataagtatgtttgctctatttttcctgtaaagagagcaacataaggagactcaggagaagcccagatgatccatgatgcttggtttttctc

SEQ ID NO: 616 - DNA, 218 bp, Homo sapiens
cttacttctctatatatgctggtacattcattattggataagaaattttgtctagttttaaatcatatagagtgtcagatatcatatttataacacttcttaattgtattctgaaaaacagtctttttaggaataaccacgcttcctctattctctaagtcccttacatatagtgacatactaaatgccctgagaaatatcaaatgtaatgtttttca

SEQ ID NO: 617 - DNA, 169 bp, Homo sapiens
gattaccagcaacagggattattgccactccatcagtaaataagaaacagataccaggtcataccttacatactacttcccaaacagcacaagtgctgacatatcctaggcttggaacaatgaggtcctcactatcctccttctgccctttcttttcattcagcctgag

SEQ ID NO: 618 - DNA, 81 bp, Homo sapiens
tttttttttgctttgacaaatccattccattgtatgttcatggcaatgccattacttcctggtctcaaaatctttatcagt

SEQ ID NO: 619 - DNA, 1245 bp, Homo sapiens
aaaaaaccaaattaggctaaatgctttatgaaagaaaaaagagggaggaaagaaagagatgggggagattgaggtttccacatatctgacacggaagttgggagcaattagcatcatgacttccagctaatttcttatgatagtttttgcttatatttggccatagtttgatcatacttgtgaatcaaacactagcagatacattgcctctatgttgagtattaggtaaaatgactcaacattccacagtaatatccactattatatacccttatagttcctgaattataaactttaatttagttcagtttttaaatttaagtaaattgaagtacaaaatcataactctttaaaaaccaaaagttgttacatgccaatcttttcccctgatggtctcatatttcattgcaaaacaatgtattttaggtaattacagaattaggaaactacaaaacagtgtttcaaagtgttggtttccagctttgatatttttacctttgcatatatctatatctatatacacatatttgaaaatgtcatctttctacctataaaaattacaattcagtaaaattgtttgctagtgtgatatagaataaactaattcctacaatacacaaatatttacaattgaaatacttcacttgttcattgataatcactgttctttctacaatttatacattagtctattcctctacaatacaatgtttggcaagattattcatataagtattaatggattcacataatttgtttaatcaatcttttttatgttgattctttttatggaaagaatgctatgataaatcatgtttatattttaatattgatgtgcatctctgttttctccaaatacatttcttaatgaaatgttataggtcagtaatttaaacagttttcaaagattttcaaattgttctgcagaagttttggacttcattccatttataaaagaagtggttgagacaacagtgcctatcattgctatctaacccaccctcttgccaacaatttgaaaaggaactattctttaaaatcctacaaaatgtttgtttaactttgcattcatttagctaaatgagagcctaaaactttaaaaaatattttaatatgtattgcttgtgtgatttcataattttattttcagccaatttttcatataggttattatctgtaatgatttgaattacagttaatctcataaaatgaaaatattttctctcatgtgactttaatattgat

SEQ ID NO: 620 - DNA, 377 bp, Homo sapiens
ggggaatttaaatgtctaaatttcttaattttatcagtggtttatatcattctctcacattaaacatttatacatggtgtacctatttgcatattatatgtaataaaattgtctatcatctttattaaaataatctgtatatattatcttataattaaaaccatattgataataaaaaagaatttcacacactttgttcaggatattttagtctatttttctgagccatttatttttatttcagaactatactgcctacaatgtatttttatgtttagaaattcatgcttttcaccatatatttttcaaaattatgttgtctattttcaaatatgcattatgcaatggatgctaatgtattttccgtgattcaaagg

SEQ ID NO: 621 - DNA, 428 bp, Homo sapiens
cctataacagataaatatctactatgttaacttttctttctacagagcagtaaggtagatcagtacatacaaaatcaattaaagaggaaagcgcggtacatcattgcaaggaaaatcatcagtttctttagcctactcccaggttctgataattatcctgacaatcaaaccatgtatgatcataaataatctccataatcgcaaaagggctgttctcattaagtttggactatttatttctatagattcaccaagtgtattactcttgcttgagactatttttaaacatacgttattgagaaaactaagactagataattaacttctatttgtaaactttcacacagactcttggattgaacttttaaaaatttcaacaattatcccttctattttgacacaaagaaaataagctcaagtcattccct

SEQ ID NO: 622 - DNA, 307 bp, Homo sapiens
tcccttcccactagctaccaagctggtttccttgagagagttgtgtgggcattgatttaacgtatcaagtgtttgtgttccataatagtgtccttgtcagaacagattgtacaagaaccatactcaaatatgaaaccttatatacaaaaaggaacaaagaaaaaaagaagccaattcatatttactcttagaagctgagaaaagacatgtacgatttaagcagcccatgaggaacacttctccagtacacaatttattgctctatcaggtgagttctcatttatgacttgggaataagttacacaac

SEQ ID NO: 623 - DNA, 2105 bp, Homo sapiens
atctttttctttcctcttgcaatctcttctttgaacaccctcaatctgatttttcttctctttagagatttcagctatttctcatagaaaggggaagaaatatatatgttttagtacctttgtcttgcaaaggaaactttctcagacattgactaggtgcaaatggagcctctcttgtatctgtttctagactgaaagggaaaatgtttgctttggctcatcttttatgttgtaatgccattcattacagtctccaatgaaaaaagaactttattgatttccatgctagtaatttaaaaagcaaatacacattacaaatgtgaggattaacctaatttttttattataattacatttatgactactttcctggagataattcattctaacgttatatatatacacacacaaagcatattcttctcattattaagaatcttgtcactgtttctaaaaacataatagcactgacattataatgctaaggcacatttgactcctttcacctgacttgcatttgtcaccatgtttacagtgaataattctgccttagccatacactgtaagtgataccggccctagttaaatgtttttctgacacttcaaactgttccctgggcaatcactgttaagccaagttagaggaaaataacattgctgcagtaataggagagttataaaatgtctcaattcttaagtttaccgttagttagtacattgaacattctgtatgataaggagaaaaatctcacaggactttgtggctagaaataacaagacatgtgaaaattctctgccaaatagtccatgtcctgcatcatttttcagtgaattatgctttgaggcttcattttaggttgcattcttcccattagtttcattcttcatcctcagaggaggagaaaaatggagcaacagagtgttctctgaaaaattgtatacccatagcatatctcttgaacataggagcaggaaaaaaataactcaaggatttcatttgaataaaaatgatttatctactgagtgctgaaggacatgaatatattatgggtgtcttttgcatttgacttttatttctttcttagcaagtagatggcttcatagaatgcttaaaaaacaattctaaaataatatgatacatttatttctttcaatgacatagattttcttataaaatatattgagctatatatgaaattttagaccactctatatgttcaaattgatcctaatattataattacctttgcatctgcaaaattcactccatggttctataaactttcatatgttaacatacttttacatttataattaattgctttcagtgttaaattaatattaactctaatcgtgaagtagacatgggcagtggttcaggaattaatttttgaaaatgaactttctttcattaacacaaccatatataattatgtacaaaaatggaagtattactgtatatactgtttttatgcttgagaaattttgcaatgctgtccttgttcacatgtataattttttgatgtatatcgtgtatagttttttgtatttaaaataaccaaataattttcacatatatgtgataacaagattttgttttagtttatttgatggggactatgacacttaacataacacttttaactgccctttgtttttaatgcatttaatatcttcagtactagatattactgaggccagagcttgtgcaacttaatattttcagatcaattcagagaaagaccactctaaattatgtaggataaaataatgtgataattagagaatagaaaaggtacagggttcttatttactctaatttgaattctaggttgaatgatttaagaagagcaggtattactcagccatctttattttcctaatacttagcacagtctttgccatacagaaatcagattatttatgaagcagtggcttttgagaaagcaacttactattttctgaattgtaaacctgacggaatgtaaacttatgtatcggtgatactatttatcattcagcaaaataatataagaatgtaattagagattctagacagatgagtgtatgggaagtcagttaagtgacactctgaaagttaaaca

SEQ ID NO: 624 - DNA, 21 bp, Homo sapiens
gttaaacaaagtccaccatgt

SEQ ID NO: 625 - DNA, 258 bp, Homo sapiens
ggagttaagcaaaaacattggaagaataaataaaatttgtctcccttagcatggtcaagagattcctcttggatgcagttgtagcttcagaaactacaaatattcccacacatttatcctatattcagagatatttgccttgtgctccatgaaagcaaaggacatgtattttgcccaccattgtcagatttcctgcactttgtattttttaataataatgtttttcatcatttttccttcaacatctctttccaattc

SEQ ID NO: 626 - DNA, 1547 bp, Homo sapiens
cttacattgtttctcacatcaaatggatggaatgtgattatctgaagcattagtcatgtttcttcattgtttttatagtgcctagtcttgtctcacaatcatttaggaaatactcactacttttatgatcaatggataattggctgcatttacaactacagtgtccactctacttgaccagcagcagtggtcttaggtttgaattaaaaatcaatttatgagacaaaataggcttcacccaataccaagtttatttagcttgaggaatgaataaacatgagtcaaagtcacggaatgtatagcaatagtatagtagagatcactggactcataggcacacattacaacttcacagtttctctgcactgggattctggatgttcacaagtgataagactgtgtgggtttaaatgtttccagttcagggaaaccttcggaatcccttctgagtgttctcttgctaattaaaaagcaccctcaaggttacatggctaatgcccattttctggtgcagctgcatctgattattcatcattcaataaataacctcgacaggaagtagagttgtttgtttgatacatgggaatatggccaggatgtcatttttcttggatctagtagtataaacctatacacttcttgatctagtgttgcaagtagaaggaggattttatttaaggtcaaaatttcaggcttatatcaacctagaggcacagcaacagaatctaagaataaccttttttgtataactaccaaattaatttgaaaactactaaccattatcatttgaatgtgactgtttaaatcaacatctttgagagagtctgttttcaaatttactttttaaatagaccctgttaattcttgcagcctatttttaaaaacctctgaagttataataacctcataataagtcgatattttaaatggatatttacaattttttattttgccaaatttcacaatttcattcatagactgtccaagaaaaaatgtattgtttaagatgcttaaggatcttcctcaagaaatcatgtgatttttctaaaaagatcaacatttaaaaacagataaatctgttgtgctccaatcaaattcatggagggaaattgttataaataatatattgacagatatcttaaataactacaattatagttattattataatgttagacattaccatagatgaatgtttgaactataaggaacacatgtgtctaagctcttagtcttatttatttttaataagcaataatttaatgtcaatttcaatagcacagagaatgtttttgcttaacttccatatctttttaacaaccctttaaaaaaagaggtgctagaaacgtttatacctacctatgttttcatatatttcacatacaataattaactttttaaagttatatatgtctacaatagttttcatgaatcatataaacacatatatttcaaaagttcaaacatagattattaaaagcctaagattaaagagtattaattggaaatccatatgtatacagtttcttaaatacactcaagtaaag

SEQ ID NO: 627 - DNA, 160 bp, Homo sapiens
gcatctgattcagttaattaacataatccaagatgtaatcaacaatttctttcattgaatgttatttgtgtttgctttaatgttcataagacagtcttatagaaacacactacaaacaaaatttcaattaaacagtttatgacaattttttaaaaagcca

SEQ ID NO: 628 - DNA, 138 bp, Homo sapiens
aaaaagaatagagtttcaaatgttttttgcagtgggttctcatgaaccagaagtatagagctgaaacatcacagtcccctgaagggctccacccaaggatcgtaggaaggaaaaatcctgccaataggcagaacatcg

SEQ ID NO: 629 - DNA, 1477 bp, Homo sapiens
aaaaaccacactcctgacacaaaagaaaacagtctctattctctttatttcaaacagatagacgtctatatgggaaatttgtcacaatgttgctggaactgctaggtcagcaaaaaaataagatggcgtcaagatgtgcaaaaggattctggccctgattccagtagttgttgctttcatggcagaagtcagttttccttctggtcctcagtgggtatgacagagtcagcacaatttcagtgactctaggctgatttgaggtggtgcatgttagaaaaagaattaaatgcaacattatcttcagctgcagagtgggtgatgacttacatactctagcccacaggtatctcctttctatttctcttggccctgcctcctgcaagagtttctttctttccctgccctatagattttttctaatgattttgcaacagacgtgctgtttccataccctcgattgaaacatctagactgctttttgtttttatttttgctctaaacctggcaaaaacaataataattaaaacatctagccattaatggtatgtaactttagttaagacttattaactattgaccatataaccttgctgttttcctgctttgcatgtgcaccagtatgacatgagaagcaacttttgagttaagctcttcttcagctgccctacttggcttatcaggagatccatgcctcaataattattcttacaatttttgtttagtaactatataaaaaacctgggtcagatttagttggaaatatagatattctaaatctgatgggaaattaatatctcccaaaagaaaaggctatgctttaaaaggttacttgaatttgcaatatgtattcttcagtgttattagtttcttagcttcacagacattgtctttaactgagactggtggtcagatttacagcctaatttaatagtgattcgcaaatattcacacttttcaattttgtcatcttttctttcagcataattttataatttaagactaaacaggatgaaatgagtatttaatctataatttgagtagcccaaaacttgaattacaataagcaataaaccaaaaatacaggtttccatctatgaaagcaaggggaatacacgtggcatatacactcagtaagaagagactagaaactgatactgtaagcacagctacaacctttattcatgtaaaacagactaagaggtaaaggatctattacccttcataatatgctctctctttctctctctatatatattcttctcactaattttattacacattcctatctttgagattccaacatgtgacaagaaaacaagatggaaatatattccagaagagcagatgttattgatttagaatcattcatttgaaaatgttaaatgtcaagtttttaaagtttttaattaaatcttattgccatttgattttataagcatacaaaccaggttaggtcaaaattcatgtgtccatgtgt

SEQ ID NO: 630 - DNA, 109 bp, Homo sapiens
tttcagtgtaattgctcctccaactctgcacgggtccaacacacatttttacggaaacagaaagtactacagtttgggtgtgagaaatttctggatgacaattcaattg

SEQ ID NO: 631 - DNA, 323 bp, Homo sapiens
ctcagtttttcctatagcgttcccttccacacagccaggaaatagaagtattttatatctctgaatcaccgttttccaaatagggaaaatcattttggattaaattaatgaagaaaattgttctacaatgttaagccattgagacatttatttttgttggttatatatttttattgatatttttactgattatatttattgatatgtttggtaataccacactaaataaaaagtatcagacaactcaaattttacccatttttaaaattaatttgaagtgcaaaagtatagcaaatgcttgggaattttaaagtttactattc

SEQ ID NO: 632 - DNA, 48 bp, Homo sapiens
tctaccttcaacttatgacccggcaaagaaaatttctaattcttttga

SEQ ID NO: 633 - DNA, 515 bp, Homo sapiens
aataaacctgacattgtcaacatatctcttattgttaaaacaactttcaatttaaggaaaacattttatcatattaataaaataactccaaagggactttatgcaatcattatgaatgtaaaaaacttactatatatttcttaaaaattttactgtatttcctatgttatgtttttgttcattttttaaaatgttatgtatataggtgtaatgtacctcataacattgacaagaattaaatgacactaaaaagttatgttttagagtttctcaaagagattatgctttaaaattaatgttgtacaaatgctttgataaaccagaatgcacaaaagtcctgaaaacattatttatgacagggctattcacatacattttgattattctgtgtagaagctgaaaggtacaaacaacatatgtgatataatcttgtagcttctcagagcaaaacagcacctttggccttagattttgaagcataatgcttatttgttataagatcttaaagtaaactg

SEQ ID NO: 634 - DNA, 967 bp, Homo sapiens
gtttgtgttttacgctaaaatatttcagcatatgataactctgttgggaaataaaaactgatctgacttcaaatagaaggaagagaccactgggaacattttttgtagaggtcatgcaccatttatctatttgctttaactcagaaatttcaaggtgtatgttaaacagatgctggagaactcaatattaaataaagttctcagaaatcagctccctgtgaagtgttaaaagagttttgattttcaataatgcttagcatttcagtttatctcagaatgttaaaaaggcaatgttgaatcaaacctacaaaagaatttgattaaacctgagatgagattcccaacagatgaagcaatgcccactaaggaaaaagtcattgtaagaagtgcagaacaggtatcatgtatgggttacatgagcaagaggctgccagagcaatcattttgactccatgatttgaattaaacaaaattattatgttaatatgctgattgtttaatcaaatccaattatttattgttatgttttattatcacagtcatgttttcttagacctgctcctgaattatcaaaggtacaactggttccaaaggagaattggtaaaggaaataaaaatcatatttgaaggctcaagacaaaggtgttattttaatttacttatttttatagttcagataaaatgaaataatttttctaacacaaaattatcagggtctttttaacaggtgtgatctcatgaaaaaatgagccaaatattcatacccacaaatcatggatggtctcctgagcatgtttaaaccaactaaatttggtctaagaatcttgcttattactagaaaaaagtgcataaaccagaaatcaatagaaattaatttaaagaaggaaagctatagcttatgtaaagttatcctgctgaaagaatactattctttatttcaagtgccatatgaattttagaaactatg

SEQ ID NO: 635 - DNA, 1226 bp, Homo sapiens
ctatgtaagaagagaaaaaataagctatgcatttcttttccagaatgagaaatatgtccaagtaaagaagaaacacaagatgactactctcctctttataaagatatgagaaaattattttgtaaacatttttacagtaagtcaattaagaaagtcatttttaaaatgacatcagggaagtcattacaaagcaaaattatgatataatgaagtatcccatttctttttcagaaaatgtaaatatgaaatattttcattatgttaaaacaaacatttcaataaccctacttaggttcataaagtttttatatacaataatgcattcagaaaattgtaaatacatgcatacatgtgttttatgtcatgatctaactgtatcatttagtatattccaagaagctttgtcaatgataaaaatgtttgggagaatgaaccaaagaatcaatcatgctgtatttaatgtgccattctggaaaatccactcataaccctttacagtaattctgatacaatctataaacaatgtagcataatttgtttaaacaataaaggagtgggcctcttctatggaatgactattacttagagtatgtgatagcaaagccctcaagggttagcaggaaacattctggtttttgttgttactgtccagacagaattattgttagtactttctgacactttttctgccttattttattaaagttggttttaaatatgtctgaacttaagtgttgagaccaaatattaaataaacgatgtcctctgataattctaaaacatagataaactgataatgggttttacaaggatgtcagaaaattttttttcctaggacaatcagaaattcagaatgataaatttctggtgtaagatggttgggaaacaaagaaacttaattttttgtcctttaaaaactttacattatgaaaaatttcaaacatattcaaaggtaaaaaaaataatatgactttgatccctctcaacttaagcatcaacaaaggtcaatttattttatttccttgtcctagtattattttgtgtcaaataccaacttaaaaaattattaccagtctattaacatagttcctttatattataatatatccaatcagttttcccattttttgtttcataaaaaaataaaagttaagtttattccaactatgtaatagctgctttagtctccagtatgatcactccattagtatctctctttagaaatg

SEQ ID NO: 636 - DNA, 36 bp, Homo sapiens
ttacatactaacaataatataatgagtgttttttgc

SEQ ID NO: 637 - DNA, 173 bp, Homo sapiens
gtcacttataaaccacattcttagtttcatacagttatctccaaaaggagccatgaacctgagtctgatttatacttcaagtcattttaactcagttatatatacctgcatgaatcatctgtaatgttgtctttgtgtaggtatattttcattgtcatgaaatatgtgctcta

SEQ ID NO: 638 - DNA, 127 bp, Homo sapiens
tgtgctgtattaattgctttggaggtttttttcattaatattattttttatctaaatctacttagatctaagtcattctctttatttggcagacagtattccagccattgagtctaactgaataatt

SEQ ID NO: 639 - DNA, 288 bp, Homo sapiens
aattttagtctgaaaagacataacttgctatatgtaattcacatgtcatcctacagtttgtcactttgttcattttatttatttatttattttgatgtgaatgtgtgtgtgcctgggtgcatgtccatatgacgtgcttgtactttttttaatctgatatatatgtgagtgttctttgttttaagaatgtttttcatttccacatcccaaagtcataaagatattgtcatacatacatgtttgcaagagctttgaaggatttgatttttttcttcttcttttcttttc

SEQ ID NO: 640 - DNA, 757 bp, Homo sapiens
ctctctttggatttatttttctgtatagcatctgttattcatgttatatacaataaaaacctgatatttctaatacctacttttaaattatctagatatttatctttgttttggaatatcacctggaacttctaccaatgtttcaagtgtacttattttttgttagattttaactttctcttaaatgtatactatacttttcatcttggagttagtttttgttgtcatcagtgttatataaaatcataggaaatgaaactaaatagaccttacaagtgagtattaggtaagaggataacacaactatgtgaaaaaaataagattagaacttaaatctttttttaataactagacgtattgtactgatttggtaagtataaattcatcatgtgtcacaagtgtaacatattgaggagatgaaaaataaatgctaattaccatgagagggcttgtcatcttctggataagtcaaaagaaaaaagcatagaggaaccatatgtaatggaagcttgtgctacaaaatagttactaccttagactttggaaagcacatcagtttgaacccctggtactagcatgctattaactaacatctttggtaactgaacatatatgtaaacatttttggtaaaaaattatttgatgttacatgtataaacaaggttctggttcacagaaaagacttaaatgctaactattttatagcatagcatttgtaaaatgctacagtaagattttttaaaaaaaacttctgtat

SEQ ID NO: 641 - DNA, 75 bp, Homo sapiens
attagtccaagaactattgttttgtcataaatattagaaacatctcttcaacatacagcacttctactttatggt

SEQ ID NO: 642 - DNA, 39 bp, Homo sapiens
ctgtctgtggctagcaattaatttcttgatgaacttgat

SEQ ID NO: 643 - DNA, 70 bp, Homo sapiens
cactgaataaaactttgacttacctcgttacagactgacataagtccagacactagatgccagatagcac

SEQ ID NO: 644 - DNA, 33 bp, Homo sapiens
agtaatttatagtattattcatactataatagc

SEQ ID NO: 645 - DNA, 33 bp, Homo sapiens
tttggcaaaaatgtagagtaaatacaagtattt

SEQ ID NO: 646 - DNA, 150 bp, Homo sapiens
gccacatgcttttctgaaatttgaggttgttccctgtaccacactggaattgacactatcaaatagaagatatggaggggaggtcttaaaaaataattaccccttctttttaaaaaaccttaactttagtacattttgacatatttttta

SEQ ID NO: 647 - DNA, 97 bp, Homo sapiens
agtgattttttccctgtttcttttattgtaatttaaaaaccataatttctatttgatgcttttaaaaatctctgccaggccgggcacagtggctcac

SEQ ID NO: 648 - DNA, 33 bp, Homo sapiens
cttagcttcctaagggtcaatcctggaacagca

SEQ ID NO: 649 - DNA, 325 bp, Homo sapiens
tcagaattttgaagcaatatagatttctctctgggatcttgtcaatgtctactgtgtctgtctcattatctagatttccttgttctctttctggcttgcctaaatgtatgctttaacatttttacttaatgagtatcaaaacttcagacatctgggatgttagtctttcctcatgtttacactaggatctgttatttttgacaattcctatgggcacggtgattttctcttcttctcttaatcaggccagccacttcaacagcagaactgcaggtactcatggcctgcacagctctggaatcactactctgccatgaaactcagt

SEQ ID NO: 650 - DNA, 93 bp, Homo sapiens
cactagtgtgtgtgtgtaggtgtgtgtacgcaggcatgtatgcttaagttttcatcttgatactccatcttactctcttggtctccctaaact

SEQ ID NO: 651 - DNA, 168 bp, Homo sapiens
aagaagttccttgaattatctttcagattcaattaagttttggtaagaaatctaatgaacatgtatcataagcacaaagaatagtaaaactgtgataactaacaaaaagacttcttattcttttaaattagcagataaaataatcaacttcatagatacctacatcat

SEQ ID NO: 652 - DNA, 682 bp, Homo sapiens
atttagaaatgctctactttgaaacagtagcttcaaattcttcattcttgcactataatttctgattgttacagcagtctaattttgtttcttagactgttcttcaaactctagccctctgatttcaatctcaattcaatctctgtatctatcttcatttctttccctaaaatatttttatgatatttgactacatttaagtcaagatggtcaacttttatatctattatatataagttaagaaataccacatctgactcactgtacttatttgactaattttgttttaaggcaaggtctctgagtgatattagagaaaataactcatatagaatgtttgcagtaaacacagtgtccaattttaactgaccccacaaagctgtcctaaaatctcgaggtttcactattatcttttcacatttactccatcaggcattagaaagtttctccactatcaaaactacacctccattatgccttttttcacatcagcaaatgaccaaggtgaattaaaccgttaactaggaaactcttacatgtcttgatcatgtccgcatttgtaatagcagtcacatctacatttcctttcctcttacaaaataaaagtatcttttctcccaatcaaaaccagtgcctccacgagtgaactcaatcaggttttaaagaacaactgataataaac

SEQ ID NO: 653 - DNA, 185 bp, Homo sapiens
attttgtatttctaatgagttttgggaggatgcttaatgcttctggctcataggacatgctttatgtaaaatgaatataacatattttaccatattaaacacccttttttccttatctttaacttctttagtttctcctttatttttacatgtttatttaaactcaagttgccatcttacatctt

SEQ ID NO: 654 - DNA, 301 bp, Homo sapiens
aaacgtatcatttagcctgccttaactcttgctttgaggtcacaaatgtcaaagtggttaactccaagtcacctccaagaacattattcctattgggttaaggctccacccttttgagctctaattatctccttaatgtgtgagaactgggggaatatgttcccaaattagaaataagttctctaaaactaaggcttccaatgctgaagagaatgtacaaaatgagaaaggcatactcagtccttcacttacacagtcaaagagcaatttttagggcactcccatgtgccagacagcccaa

SEQ ID NO: 655 - DNA, 195 bp, Homo sapiens
ctttcctaatcattcaacaggtatttgaggtgctgaaacattgtttaaaaaaaaaaaaaaaagcccaggtgcaaacacttctatcagatgtgccatgcatcattgacaatagtatacacatattatttataatatgtataggtgctttataaatattaactcattttatctccataataactgagctatggacaa

SEQ ID NO: 656 - DNA, 3524 bp, Homo sapiens
gtgtaagagaacttggtgggttccttaaaccctgttcaggatctgtcactggatttgcctgttgtgcattcagaggctggagaaggagtggagggggcagagtccaaggtaggacactaagagtcagggagaggtgatttgtgaaaggctttaggggcagcgccagcctctggataacagggaccctggtggtaccaaggaatcattggcaggactctgggagatgaggacttggtctgcatggggcagcacctcgcatctgatactggcgcatatcagcaccctactggacacattcaaacaggcagcaccctgtgagtgtctcagcaccagcacatcaaccttccaattcaccaactcactccagggaatgtgaagggcagggttccactgggccgcaccacccagcccggggtggccccaaaggcagaggggatgtgagtgctgtctctgtgagcctaagtaggccctgcacctgccagagacagggcacagagcaagtgtctgagggcaagtcacctggacacagcagtggcagaaaccaaggagtaggcatgccaggcaggtctccagcagcctctgagtttccaggcacagggcccacaccagggtggactttttatatgtacatacacacccacacacccacacccccacccaaacacacacactgcaccagtcccgtttcctcagatggacatttttcagaagaaagccaatgacactagcaagtccatgacccatttcaagatatgacaggacatcattttccaagtggagaaaacaaaaattctcagaaagccctgtataccacagaaatccatacaccagtttcaagtctcatccaacagaccagccagagtgcagggccacagggcaccctggctggagtgaacaagctccctccaaaccccctcaagattctaggcccaccagcataaaagtcctcttgatggtggggtcattccaaccccatctggggttgtaacctctcagagcagaggaaaataaacaggctgttgtcaggcagcccagggcagaagtgatgacacctgctcattctgaatttatctttattatacattatggccacctgtggaccattcagaaaagatgctttttgagtctcaagcaagtgactctttaagccgaatcacaaagaaattcccattttggccagttctgtttctggacgtcaacacccccctctctgtatgaataaggggtcttccagatggccaggaacagcactcaacaggccaaaacaaagcagagggtggcttgagaactacactgctacattcagcctgaggcccagcatcgacctggccttctcccacttccaacaactcattttgtagctttttggttaagaacaaatttggatttcttctttttctcctcccagtaatctcaaatgtatcagaagaaaggaaatttctaccattattgtcagaaacaagacaagtaaaaggccatcctcaaatactagtgttctcttcaccagacagcagcacacgtggagagtagcagatctctaagcacgacccagtgtgtaactccaaatggccccattatcctatctcgaggagagctgcgcatgctgtaccctgttttacatggcctgccatgcttctggtagcaaagcagtaatctcctggttatgtagcactggggatgccaataacagccagataaagaatagaactcatgaggccagttattttcagtcaaaccaagctacaaaaaccacagtcatgcagaagctggaggaaccaccaaggcaaagagaatggaaattcccttatgctagacagcacaggtccccagttttctggggcatctgaaacttgatgtgacagcactgggagaggccaacagtccacgaataggccaggacctaaggggaaaggctaccactctacagccggccatcagggtgctgggctacagcagggctggcaggagcagacggaggccacatgccaactccagcctctgctacatatggtcccagcccccctactcaccagccatgcggcctcaggcaagtgggataatccccgtgtctcagtttcctcatctttaaaaagtgggataataaaagattcatgtactttatagggttgttgtgaggatcaaatgatttaatatacaaaaaaatgttgacaacagggctcaacacaaagtgtgctcaacagctgctgttggtattggtggtggtggtgaatggtctgccagcttggtagggatgtctatgaagtgggacaaacatttcatgagtatgaagatagactgttcagatgatactcatctaatgccattggcagctcctctctttattgtaccaagatctgtttccttcacgtttcacccaacgtcaaccagcccttcccttctttggactaagtctcccttcaacacatcctcaaatgacacagtttccagtcccctcactcttagtcaccctccttggaacaagctcaagttgctaaacaactatctctaaagccagttcccacccgagccaacattccaaggccaaaaaccatcacctctatcatgagttgagtatcctgctttcattaggggactgcactgacgtggctgcaggttgctggtcagccctagggagccagtaccatacagccagtacccgcgagctccctcctcacaagaggcggctgttgcctccttgtgccagagctcctgggctttggatagaggaattccactgcttgggtctcatccttactcaccaacttggaggaacttccatagagtggatggcagccgcccctccccactctgtctctgtggtgtgtgccccacctaggctgtgtttgggtgcctgtagtacctcttcctgttcttgtctcaaacacacacctgtggggctcctttcccagtaccgtgcttcacaacggggctctccttagcccaggaggggagaggctgtgcagaaaggagacttctatgacacccttggggcaagggtgttgttttgctccttccatagatctctgaagccacagctatgcaggagaacagaaatagaagccagccacacccagtcttctttggcatgggcacattgaacgggctcagttctcctgccacgactgaaagggcaccctcccacagaaggcacatgaccactgttccaagacagtccagatcaggagagaggcctttgaccagggcaaagcaggtgctgatgagaaggcacagcaaaggtggcccaaaccactctgcctattccctatccctcccctgttaactccactcacaattccaaacccagagccctagcttctgagatatccaggtaggcgacaagattttctttctctacatgatacagactgctgagaggctcccctaacaaagcaccagtattctccctgaagacacaggctcaaattatgctctattcaaagctggctgtgttcccaactcctaagccctgctggctccctctgccccccaccctgacgtgggggaagatgctacaggtgtggggg

SEQ ID NO: 657 - DNA, 125 bp, Homo sapiens
ggagtggggaaaccaggagaacagggaaataaaattggttttcacaatagctaaactttccctatcctcttgagagtatttctaagcaaaagagaaatatacttttctttttgctttctctaaaa

SEQ ID NO: 658 - DNA, 310 bp, Homo sapiens
tcaaactgacttgatttagctcattattaaacatgcaaataagaaaattcctgttcttggaatgtgatcagtcatctgcataaggtcttgcgacatatctacgattgaattatttctttgaatcaaggattcccccggccacacacaaatcagtacttgccttactttggaaaacgaaaagagctcactaaagtggtccctcttataataaggtgagagtggcctctaggacaaatttcagcttgtacaattctggaatacagaaagggtagctggctagcgacctttttccatactccaccaggcactg

SEQ ID NO: 659 - DNA, 999 bp, Homo sapiens
actgccaccccatagtcaaattaagccgatcatccccaaagcaatattagtccagtccagttcctctcatgacaaatgacctgaacacaggattcagcgagtcttactcgctgtggtcattttggaggtagggagatcattaacccacatactttgataaaatacgaaacgcctttcctagctggttcttttcctctcctataggccgacccccctccatccctttattagtattgaactgaacaaattagttaatatgggaacatttggatgtatcaactttgctctgaaacaaaaatgtattcatccccaaactctatgctgggggctgagggagagtccttacgactgacatagtccccaacaaggttctcattagtcccagtttttttttggacaccttttcctccgcattcacatccttctgccctctccagcactgtgcaggaagaaccaaccaacctgaccttggtgaaagggctgtgggtttttcaacccttcattcctgctactttttttttttaattttttagtattcttctgtgcatcctttcttctctcctaggcttctcacccagcctctctgttgagtactacttgtaggcagagctccctcattcacaacatcccaatgtatttgtcctgtatcaaagcaaaccttatacagtagctcttttaagaactgctaaaggaatgaaggaacaaaactgagccaaataaagcaaaatgaagaggatatgtatgcaggcaattgtgggaacatatcaccagaatcctctcttgttattgtacccaaatccacacattctcctcagtgttgtctgggaaatacatcaatccactgtgaatggtttagatagaatagaatccatcaatgtcaccagcttgattcctcctcagatgatgagccactttctccactccacctccagggctggccccagtcttcctaaatgttcattaactcctattaggtattccgaaactctcaggttttct

SEQ ID NO: 660 - DNA, 561 bp, Homo sapiens
ccacgtgctaacctaataggtgttcagtaaataaatataattttctatttttccctgcaaaattcatttcccaaacacaatctttattcttttttttaacatataatagccatactatggcttaccaactccccagtaagccaggactctctgtatacgcagtgttttgccacatcatttacatggatgaaattgtttcctatactcccaaatttaccctgcttggtgaccaagaatcacttctgtccctattactagtgatatcatgtctgcatttagaaacagacaagtgttatacaaaattacataatatgataggaatgctgtcaatggatatctattattatatttaccagtcaaaattttagttgttataactggtatcaccaattaaaaaattttataagaaaggggtttttgtaccattggatctattgaatcattaaaaaaaaaaagagtttagaaaaagaagaagctatttatatactatttcattccataagactttatccagttccactgttaataaaatgtacatgcgcagaattgtattgttttctc

SEQ ID NO: 661 - DNA, 152 bp, Homo sapiens
aaggacacagctccctggtatgggaaacagatactttatgtcttcagttgtaaggtccactgttgttcctatttaatatctttgaatgtggaatatatcttacaatgctgtgggctagggcatggttgtgacattgataaaaagggctctta

SEQ ID NO: 662 - DNA, 133 bp, Homo sapiens
tataataaacaagtaagcaaaacataagatcataacacgtcctgaaaggacctctcagcaagagtgacacattgccaagtaatgcacattgttccacatggagttggtgaggataacagcacttccttccaga

SEQ ID NO: 663 - DNA, 134 bp, Homo sapiens
cttctcggctacatgaaatggtacaaaatacgaattaaatgattatccatggtcttgtgtaattctggcatgtttccagctaagacttctcagctgttcattcaactcaaaggcatccttcagtcctcttcccc

SEQ ID NO: 664 - DNA, 452 bp, Homo sapiens
gtgttttgcagtcagactgatttcctcattagcagagagtgttaaccggtagcctagtttggctcctcgaggtgcctgattcagacagagcatcccacagctggagcaccctagctggtggaggtagggactcagccaagtaggctccagagctgccacctaagcccagtagatttctcttgcccagaacaacctggccaaatggaagatgggaggctgaaatcctcactccaaggaggggcctccttttcttggcacaaaggcaccgcgccaagctacacagctaaggcagtgtgctacctaaagcaggtgcacagaattcacagagaggtaccaaataggctggcaaagaccttggtggataagtacccacaaatatctggaaggaactatgttgggttgagacatgagaaggaagagatcttaggcaagtttggaaagggaaacaacac

SEQ ID NO: 665 - DNA, 170 bp, Homo sapiens
ccattgctccctatggcaacctggaaactgtcgggtacctgcccgtggtctgaagtgggcaggcagcagtcagctgggcctccagatatgggtggtgaagggaggatacaggtccaaaagaatatcttaggggaaatagtgcacatgcccagaaaacttttatagtctca

SEQ ID NO: 666 - DNA, 254 bp, Homo sapiens
gagtcaccaagcgcctcaggaaagctgaagggcacagggtgcatgctgcagccatgacctcaacctctgtgagtctagaggtgaccatattggccacacataagctcaccttccccctacatttcataatccttccctcccatcagggccagcctttgattaaaattcccaagattatctgaggagctggcggtaccacccaccaatggagttcatctggctgcctttacaccagccaccttatggctgggtgg

SEQ ID NO: 667 - DNA, 198 bp, Homo sapiens
gggatcagggtgggccttcagtctctaaaagcatacccaagagccagccctctcagccgcaggtccgcacatggggaagccctagggaggttcaaggactagatcaggcccattttctcatcaggcagcccccaaacctctgccccaaagagcacatccaacatgctttcagcccacactccccacccacggtttact

SEQ ID NO: 668 - DNA, 207 bp, Homo sapiens
ataaccttgggctgtttggccaagttaatgcttaatgctttcctcatgctgcaagcgtttatctttgcccagattccagctccagggaggggaacattcctgcagaacagccaggcgttcccaggtcacctctgctctcactctcacttttctttttgcatgattaaatccggcctaaaaacacgtctcaggggcacatatctgtca

SEQ ID NO: 669 - DNA, 1049 bp, Homo sapiens
gagcccaagctcctaaccgcttctgctgtgcagtaacaagccacgctcagggcatgggcccaacttgagtttcttccatccacgggtccagactggaaaggaagcagcaatcttctcttcttttctcactgagtataaggcacccaattcatcttctggcagctgacctggaggacggagtggccctgattttccttttacaggtacaatcactgccaatactaaagcagtgcctgtccctacctgccagggcacccaggatccttgtctccagcagtaacttcatgaggtaggtggctctgggctgagacaggacttgcatattcctagatcccttgactgtgatgtcgaaggtcctctgcccccacccctccttctattccttgtaagcttcacttggcaattgtgtagtttatgtctggtacaggaatgaaggataaggtcaaatgaagctcaaagccaggagctagatagtcatgatatatcaaataaagttttggaacaagaacacaatgggattaatttgccaatcaaaacagcgcttggcaacttgactgtaagccaagatctctcatggcaagagcagctgaagggcctgtgattgtccagctcctggggagcctccctggcctaaccgtggtcagatgccagcatcacagcccccttagctgggtaaggattctcctagtgctacctctgggagagaaagaaaaaaatctagtctgagaatgacaccagcagacagcagctctgccaggtgtttgaagggtgaaggtcatgggactctgtttttactaccctggtcaccccaattgtttcggggtattttccatagacaagaggatgccccagtcagctgtcttccgtgattcaagacccagtctactgtcttctgtgattcaagacctgtttcctcttgtgccgatcagaggccttatttggaggcatcggcctttatgtggcatggaatgtaagccctctgagctttaacagagataggaagagtcctagaacatggcagggaagagggtcggaacctctgtcctcca

SEQ ID NO: 670 - DNA, 75 bp, Homo sapiens
ggtccttggggagcagtggttggagtgggagaagggcatcgcccagctattttccaacacatcgtaaaagatatc

SEQ ID NO: 671 - DNA, 537 bp, Homo sapiens
actggaagtgtagatgggtggtgttacctatatccttgattgataagagaaggaaaatgaatttttcctcaataagtacaggttgtttgaaatgcaggctgggtgcagcgacgctgcatggtctccaggcgccttgtgtttctaaccctcttgctggacaacttggcctccacagggtagtccccagggaacccttggccatctccggcctgaaggaatcagggaagaccttccggacatgccaagtctccctgagaccctgctccatgagggctggctccctccccgacctggtcttttggttcaaagtcagtcctggagttatgtctgccaattgaccccaacctccagaaaactcagaaacagcctgtcctctcaggcctgcaaaccaggagcagccaggcccagccctgacttatgcaagtaactaccacagaaggcctgctgtgcagcctatgccgctcaacctggatcaagggcaatgtggagaaaccacattattgcttgactatagtgcagtattccaacaatcatttt

SEQ ID NO: 672 - DNA, 616 bp, Homo sapiens
tctgttcagttctctcaccctaccttgaacctacacagggtggaatgtgcctatgacctcggaaggactttagggaagcaagccccactttccccagagaggattccagtacaaacggaaagctcttctgaatggcatactctttcataaccagatttcttaaaagaaaaaaatcattctgattctagcctgaagtgcagtagaattcaagagaatttaagagaaaagtttagaaggaaaaaatttttggcaagaaaaaagactctacttacttttttccctgggatccacaaaagaagaagttgtggcctcaggctacagtagtatggagccaaaatggactcaaaaaaaaaaaaaaaaaaccccagaataaatcagacatgaaaataactttccttccatcccgtatctcattttcttatttgacaaaaaaatagtaaagagcaactacaacaacaaagaagaggtgaaacaagaatgcaaaaaatgatgggaagatggcaacctccaaaatgtaataaattaatttcagcagctttaaacctaaagctatttgtaaagaatagctagaaaagaaacccactcaagacaaacttaggaatttcttctgagttca

SEQ ID NO: 673 - DNA, 1297 bp, Homo sapiens
taattgaggttcgacattatagtgaagtgatgctagggtgtcacaagaggtgaaggacaatacaaagtttagtaactattgtgcacattcagaaattgagacacagaattactttcaagaaaaaagtaaatgggagggtcaggtgtccaggtcagggcaaaattcaagatggtgggagtgggagaaacattcctcaccatggccttgggcagaatctgcttatctccagacaaagctcagcaacagctaggagctgaatctgtaaggtccagcagtgactaaattcccacacaaatgtttccatctttccatcgtgcaagaaattctgaagccaacattgcccagctacagatcattggcctgaccacagaagccagggacagagctgcggttacatttattacataggattgttccatcctgagcagagtacatggcctggagagttttcagggcaattatgaaatttcggtcttccagaggacccttgccaggtctaggaatattttcagcagtggatgtttacaaagcaaaagcccccctacacacacattagcaaattaaataatgcatgttgtatgaaaaaccttgtgaggggcatagcaatacccgaggcttctttcttatgcacttgtgtgcccagtaccagccaatacatggaaagggctcaacaaacactgaactgagcaacagcttctagcccaggcatcatgggcgggaggcagatcctgactccaatcgggcctcctatggtagaatccctggttctctcccatggaaggtgccccacctcaattgcctgcagtcacccatctgctgatgtccttacccaaaagaaaatgaaataatttcttcttgtatgaaatatcaggaaccctcaaacctaggagttaactaggaatagaaaaatcacttgctgtaagaaataatattagaaatgtaatggctggacccagcttctccttctaactaattttaaggattgttttgctgctctaggaacttactgtcatacagaggacaaccccaagcctccctagtccatcaaccccttttcctggatacaggggctgaatcccttgatggatttgatcacttacctcaatttaatattcctcctcctaaaaccacagtatcatccccagattcttatcactggtgtgactacctcttctgaagacatgagaaaagctccagtttcagaaggtatgcttggagaatgtgctgcttctagcttatccaatatggaaccaatttcttcactcatagctaaagcatatcctttcctcacagctta

SEQ ID NO: 674 - DNA, 71 bp, Homo sapiens
aaaatgctgaagatcaatttgaatatatatgtatatataaagagatataaataggatcacacgtaaggaac

SEQ ID NO: 675 - DNA, 135 bp, Homo sapiens
atatgaaacagttaaaagtctattgcaacactataatttgaaggggaaaaaaaaggctaaggacatacagtaggccactgggcagacaaaggagatcattctgagcctgagtcctcagtatttggtgacccagta

SEQ ID NO: 676 - DNA, 366 bp, Homo sapiens
cttcccttaggatgcccaagtgtcctaagtgttctaggaataagcgacagactctgatctcatggaggctcagacccctgggcttcagggctctattccttccacccctaaatgtgacctgaagtggcccctgcctccctcagtcctagaggctgctgctcaattacagtgaagaatctcttatagactcacggtgacttaaacgctatttggtgctgtggctgctatttcactgaagattacagggctctcagagttaaccacataaaacttgctgctatatatttgtaacctcctttttcaataacacatagggaaaccatcttgggtttcaggaccaaaaaagtgtgagtgcctggccaccag

SEQ ID NO: 677 - DNA, 130 bp, Homo sapiens
ataagatcacatagtgtacatttttgggtgttaatattgacattcctatctttattgttttactgcccttattttctctttgtcccaagttcttcaactatgaatttttgccaactacttcaagttaaaa

SEQ ID NO: 678 - DNA, 106 bp, Homo sapiens
tagacttgactgatgctttatcttctctcgacctcttccctaaagcccctacgcagggcattcctccgctgcaacacagcaaccacttttaatagttgcttttcaa

SEQ ID NO: 679 - DNA, 387 bp, Homo sapiens
aataagtgtttgttgaggaagtgaataaatgaatgagcacatacctgtatacagtatacagcttcctcgctcatacacatgttaaagagagctaaagcctccgggaagggagaaaagagagggccctgttcagtccagttgtttgtggggctttccatctgacaactgttttccatggtctctcctgaacagcctcgaagcctcagccacctgggctggagcgtatctcacagctaaatccagagtaaatatacacaagacagaattggtcctatgaggacaactggggtgaatttccacagaaagaaaggatttcactgatcagaaatgtaagatgctagatgctccaattggtacttattctaacaacgctctcttctctaggtt

SEQ ID NO: 680 - DNA, 212 bp, Homo sapiens
ttttcatatgaccctcttaacatttgaggcagctatcctaaaatgaagaaaggtgtagtgtttcagtctctgaataaaagaaaatgagctacattaggtccaatgtataaatggctgaagattgagtgccagcctttgatccaagatctggatctggcaggacacctcaccgctcactaacatttattgagcacccaccattgtgcccaggg

SEQ ID NO: 681 - DNA, 129 bp, Homo sapiens
acgaaaagagaggaggaggtgggggatgagggatcatcactcaggtggtggccttggctgcaataccatgaagctgaaagtcactaacaggtatagtcatttctgttttagactctttgagcagctgtg

SEQ ID NO: 682 - DNA, 984 bp, Homo sapiens
cacagtgtgcacgggaactaaggcacaggattctagggatatttaggaaacctgaagctttggactgatcgagaagctggcatagcagtgcaaggtgacaccccggcttctgacttagacaggagggcagccagtgaaatcagcaggctaggttggaagcaggcttccaggagtgagggcaagctgagactctctataagctcagaaaagccaaagagagcggcagaaattttcttcattatctcagaaaagttattcaaattcttgctcacacctccttttaataaaatatgatgcatttcattctgtcttcatagtgaaaaatcattgccctttgctgagaattaataaccttttgagttaataccctttgggtaggaaaattggtttcattaacacctccccttgcactttgtaggttcatcatctcttggtcctgctgtcccctgaaaccaaaagcccaagacatattatttgagaagcctgaatgattttattctcagaaagaatgatcagggtccttattaaatgggctgaattgagttcactgaccaaaaaggtcagagcggccttgtgtctgctcctcagccgcaggggagcccaccttctaccagaaggaagggatgagagcttcctctcccagctcttggcctgatccctaatcttggcagaaaagatgcgcccatcttgacatgccacgccatggaaacgcgccaccttgccaggctctaccaggcctcttggcagaggtgtccgtctctggtgcagcaccacagacaggacagctgtcgggctgcctggcagagttggatggccactcacccacccctccaaagtggctcatggtcatagtgaggctcccccagaagagaggctggaaggcccttcggtcaaacaacagaaggtgatatgttaaaaacaatcttcctctccttttccacctcccacggccttggaaagcctccgaatggacattcctctact

SEQ ID NO: 683 - DNA, 352 bp, Homo sapiens
atgtatgcaaggttgcatgcctgtgagcctcgactcatgttgctccctcagccacccctgacccccgcaacaaaacacacacacacactcaatcatcctgcaaggccagggtcaacatcacattccctgaaaagccctccctgaatgccacaccctccctcaagcggcatccactactccctctgtgattcccccaaccctgccccacactcacccctgtaccttgtccctgcaaggcttacctgatataatctgtctgcacgtgaggacaagttgagcctcaggagctaatacatagtgtcacccagctaagatgctctattcactgtctctctaggtagggatgtaggga

SEQ ID NO: 684 - DNA, 560 bp, Homo sapiens
ttccttatgacctagagggtgactctagtgcttgattggctggtcactgggataacaggctagaggatctggtgatctcaacctcctaggccaccctccatcacttggccattccactggaaacagtctttggggctccccacagttgtggctcattctgatctccagcatctcccagtaacctctttggcttgtgcttgtagaagcagcctttgagaagacggagggcttcagatgaagcagatgccaggctaagcaccgtccccaatcttatattgcagagccatttggaagaagagctcaagctgttgaaacaaacaaaacgctgcatgagatgaagaccagattcctgctctttggagaaaccaatcagggctgtcagattcgaatcaatcatccggacacgttacaggagtgcggcttcaactcctccctgcctctggtgatgataatccacgggtggtcggtaggaaatgctgacatgccgtttttctctccgatttcacattttctttttttctttctagcgtgttcatgttcataaaaagatagggagctgg

SEQ ID NO: 685 - DNA, 124 bp, Homo sapiens
ccacacagcccattggggcccacaagggattgcagtccgtgcaggaagaagcctccttcctgaatctgcatgttacacacagggggacataggaagccagaagaatggactcccaatgaaatgt

SEQ ID NO: 686 - DNA, 241 bp, Homo sapiens
ggcttttggtataaaagagtgttttttaggtgtcccagagcctctgtgaaattctcccagttacatccattgaccatatctaagtggaaaggtggctgagaagtataggctgttaaagaaaatgtagccttttagtgatgctaaaaattctattactatggaagaaggagagaaaggatattattggcaatagatgaagtcaaaccatgtgagaacttgtctccaagaggaaatcctgcct

SEQ ID NO: 687 - DNA, 450 bp, Homo sapiens
cttatgagaagtctgagagcggcaggagagggaactgctgtcatttagttctggctctcccctgctgctgccctgagacaatgtctgtcctcacacctgtagagaatagctacgaataccttggagaaggggagggataaacagagggaactaaacaatacgaagggtttatttcctgtccttttctccttccaatgcccacagctcatctaaagagggttcttcctcatgctatgtctccctgagaggtaaaaggtggagaccagaactaaagagttgttttcaggaatggagaatacttgactgtgcttatttgatgaatgaatcctctactctaagactttcccacagactgggatctgtatgtccccacaagcatcaccctgggggaaaataagcttatgtgccagaaaatatttcaagagcacaaacactaaaaacgataagaga

SEQ ID NO: 688 - DNA, 96 bp, Homo sapiens
aatgaaggacaacaatatgagaagcacaactattagaatagaaagatcaacaattttaaagtagttcaccataatcatggcaagggaatatgttag

SEQ ID NO: 689 - DNA, 562 bp, Homo sapiens
caagaaaacaaataccaagcaaaatttaaaatttctagttctaaatattttcagacactcagataaattagcattaacttagcagtcactggccagattggattgacaaaaagcacacaaatatcaactaaatcattcatccaataatcccattcttacggagaaagtactgtaacattagttactacagactcatttataattcaattctacctgctaaacaattctgagttacataaatatgtatcttgctcaaatattcttacctggaagtggtttaggaggaggcaactttggattactacttggagtatgaacactgcatatcttaataaatccagccattagcatgatcagagcaattcccataagtaatactgcccaccaatgagcctagaaataaacagatttttccactgaaaaaaaaaaaactacaaaatattttagagtatcttttacagtatataaaacatagaatagaacacagtatattgtaatttttaaagaacatttgtttaggagttgtatacatatgttagatatttgcacatatatattattt

SEQ ID NO: 690 - DNA, 217 bp, Homo sapiens
gaaaccgctcaatctgattttttttagtctctttacatataacaacatttgtcatacacatgaacacaaatacaaaactggggtcatcttgcatatagttatattgcattttcccatgttattaaatattttctggtttaaatattgcctttgttttttccccttactcttttttctccctcaaatggataatgtgccaatgccctaacaaggtttg

SEQ ID NO: 691 - DNA, 690 bp, Homo sapiens
ttcctcttttatttcatttggaatttgagactcggactagttatgaaattactttttatatacattagttttcattacattatatataatatctttattgtattcattagtttataggctatctttttaaatatgaaaagtggaagaagatacatattttagcagcaggcaaagttcatcccgtcttagaagaaaccaaaacttctattttaacctgacctatattaaacaaatcaattagccaaacagaaaaaccttcaaaaattattgataaatttataggaaaattactgtgtctagtcttaaattatattttgcaattccaaatattcaaactttgttttaagaccacatgtactaataaacatcatacaaaatatttacagcttcaaaactgaacctttacatttatttaacacaggttactgtaacatatataattactactaatagtttccagcaaaactcccatttaagaagactgtctatgacttagggacttacaacaaactgggtactacttctacactgtttagtttttccagcagtgtttatataattaaagtaatactaatgctaattttagcattaatgagagtaatgctaaaattaaaaggcatgttgtagcaaaatatcccaagccactttttctttgtgtacacaaagcctttcctactttctaaacatttg

SEQ ID NO: 692 - DNA, 21 bp, Homo sapiens
aagtaccttttaaaaacctga

SEQ ID NO: 693 - DNA, 20 bp, Homo sapiens
gaaaaacttttaaaaatctg

SEQ ID NO: 694 - DNA, 33 bp, Homo sapiens
atgtattcatttatttattccctcatggtttcc

SEQ ID NO: 695 - DNA, 287 bp, Homo sapiens
cctacccttcctatgtagacaccttcctcatcctacttgcactcttgacatcccatgccagtcactcctccacaggggtgcaattctcaccctgcttgggctctgaaaccccatactggtagtgttccccatcccacaccttctgaacctggtcagcttccaacactctgctctgtgccactatagctccccaactttggcgtggatgcctaccttgcttgggctcacctaatggctttaggaattaactgcttcaaaaaaggagagggaataaaaaagggaaagag

SEQ ID NO: 696 - DNA, 253 bp, Homo sapiens
tcaattttaaaatcaaacttagaatgatttacacttgagtgtcatttctcagtcttatttaattctcagattagatctctatacagaagagtcccacagacacctttcttctctttattttcatgtttattgttcaatctgtaaaaactgtatcatggttgtccctcacattgcttgttattgcagggacggcaaactcaaaagcttacatggaaggtaaggtggaatgcaattcaaccttactgcttaaaga

SEQ ID NO: 697 - DNA, 40 bp, Homo sapiens
gaatttaaaactttacaatctactttctaaaagccacttc

SEQ ID NO: 698 - DNA, 166 bp, Homo sapiens
aggtattccatagactcctattgttttttgtttttattcatcctcaaataacagacctgctacttatcgcaagacagggtagaaggccaccctcagtctgtcaaagcagtacacgaccattttgagtaatgcagaaagtttagcatccctggcccccaaccatcaa

SEQ ID NO: 699 - DNA, 427 bp, Homo sapiens
atccatgagtacaaaggcttaagagttttcctactagctttctcacgatgatgggcaagttgggtacaggagacacacttctcttcctaaagtcattatcatcttcaatatatttccttccttcatctttactttcatttttatgaaaatatggccatcagtgttatggctacctaaaatatggaactgaccatgttactccttcatgtcaaacccttcttcgaatgcttcccaccaaagatttccaagatagaccactatgtaggagagaggaaaaaaagcaaaagcaaaaacttgagcacacgataaagtacagcaaagtgtatatgattccacctttttaaaaagtaaatatccttacagtggtatagacagtttcgaagaatacacaagaaatccatcctagaaagattgggggtccagggtt

SEQ ID NO: 700 - DNA, 179 bp, Homo sapiens
ggcctactttagaatgtattactttgtcaactaaaaaaagaataatcaaacttttcaaaagaaaaaaagtagaaaaaaatgttttgcaaaattcatacttctgtgactttttcacatgctctgtccccataaaatatttctgtactctctacttctactaattcttaagaacttagctt

SEQ ID NO: 701 - DNA, 386 bp, Homo sapiens
aaataaaaataaacaaagaacttagctctggcgttatctccttaaaggcttttcctaataggttctcccagttctgtgaaaacagcacacagactgaagatatgtttctctggcctgtcttctctatcccaaactgacctgtgagctccctggacttatatcctattacctcagtacctacccaacaaacaaaatacctgttgaactagttattacaagtaagtcattatttaaatattgaccttgaaacataactaacagctcatttattacttccagattgcctaacacatacaaataatgtgacaaggccgttacaacagagataggacagtaaaactggtttggatatatttaatgatagtctttttagtacctacacactc

SEQ ID NO: 702 - DNA, 968 bp, Homo sapiens
tatagatttaaataaagagccatacgagtacacgctatggcagtaagagaggcagattggagacagaaagcccagatttagtagtggttaaaactgtagaaaacaaaggtaaaaagaacctagtcgcagtttagatcaacagatgtataataaaatatggcactcaagcccttcagaacttccagttccttctagcacagtgttcctggctttcttctaaattttttcaggtaactatgtatctcacaagcccaatgcttgagatgttttagtgccaatgatagtagcttttgtgaatttagcgtgtggggaaatggaacatggcaatagacaaaagacagtaagaaaaactaaacaaaataaatagtgcatctgaaaatattagtaagtacggccacctttatagttttcctttttaaaaaaagaatgagttaaatgctaaattacatgctatcccctttaaatatactataaaatcagggaaaggaatactaactagggtagtaaatgtaaaatatgcatttctctcaaaagaaaagatcacaaattgcccacctgttagtctgaaagaaaggggagctgtcattcattcaatgaacatttactgagcgtaaactgagtgccagggtcttatatcccagagacaagggtgttaagcaaaactttagggacaaagagaagacatccaaccatttttcaaaaactcaagaagtttctcaactcagaaaataattctacataagaaaaagagagatgatgttcaatacaggcacttaaacatagccaataataaagtaaaaagtcaaaattaaatagtctaatttattatgtattaattacaatagtatttaatttgataatctaaatataaacaaaaagaacctatatggtaacaaaatgacaaagcaagtatcatctaaaaaaaagtgcatgagcgaggacagggaagacatgcactcaagtctctt

SEQ ID NO: 703 - DNA, 620 bp, Homo sapiens
ggacttcccatgggtcacaagaccatgtggggcccagagctccttgccatgatactgattatgtcatccctataggggcagaaagtttcctttcaatttttcagaagacataatactatagtctgggctttgaatatatactcctcctatccttcaaactcccaccaccactagcagcagcagcaacagcgatctgccaagcagaaagcaacttgctactaaacttttggttactttaagctcaacctgggcaagtaagataaaataccactaacaggaacctgaaaacattccagtttcaaagttaatatgcacaagttttactcttttccatataaattattacatttgagaaatctgcttcattcatctagcaaatgtatactgtgtcctcactatatgctgaaaaccttacaatatcattatatctttgttgttaaagtttcattaagtgctatgctatgtggtctgttccacaaagcaatgaaaccaccttctattttcaacatatcaagatgataaaatggaaaatttctgttacaagtctttttaaaaaggagtcacatatcacagagactgaaaaaaatggcagacaaactattagcacgcaccatcaccta

SEQ ID NO: 704 - DNA, 62 bp, Homo sapiens
ctattaatcaatatttttccaaatgacatctaaggatatttaggacttagtcttttcatcat

SEQ ID NO: 705 - DNA, 1496 bp, Homo sapiens
ctgttaagcatttgggaaacagtgctctaaatctttcattcataaagaataccagatacttactacttagatgcataaaattatagcaaaatatgacagcagaaactaattttaaaatgagaatgtgtttgactcttgataaattagcaatacaaaaatacaaactcctgataaatctgaacaagttaaaaagaaaaaagccacaaaatcatcaggcaatgatttttaaaaggaggggaaacacaacaatacatttgaacaataaaagtcaaggtaagaggtagttttctacaatgtcaaacctaacatgaaagatacagaaaatcagaacacatcaactatagaagaaactggaaatgaattaccaatgccctcaatccctaattaaagaaaaggagatgctgaaataaggtctcaacagatttactgatgaatgctcttaaatgtttcaagaactagatgactctttgataaatccaaaggatgtttatcattttatcctgtccaaacacacagtaggcactcagcaaatacagtaaatgtatttggaaaaatcaaaacatagttgtcaacacagaaaagaaagtatcacttccgtggtaccagtagcagcagtcaataacccatgccctgaagttctaaattgttaaggttcttcctactctaccctgcatgaggagaaaagctgccatagtgtaacacagaaagaagacaaaacgccaccaggcaccactggaaaggaaagtagtgaaactaacccctcacttctttcacagcttcttacacaagagcatcctgataatctgtattactaactggaagggcacttccctaacatgataaatcccggtatgcaagtaaactatgcacataagcaaatgagacaagtaacttgtaaagaccagatgtttattatcttactgcttgatgtggttaatgcccacaaatgcaccaacagcctagcggtactcttcacacattatgagcatgctattcgaaagactggcatatgcctgtcaacaatgatataaaataaaggcatgttctatcccacacacacttaaagtcaacgtctatgaacttgaaagtgtctgattaattagttccagagcacaagaaaggacttcatgttgccaattcattgtgaaacatttcattaatcctcacatctaaaatatggggagaaaaggtcttaaaaatacttaaaagatcatgtctattaaatatttttaaagtgaaaataaatgggcttttgaaattctaaataatgtaatgagtgaaaattagagataacagagaaaagtaaaaaaatgctatgtttagatatgacttagtaccccaaaaatctaaaatatctagcacaatatatactcagtagaatgtaattctgagatctcctttcgttttctgtatacactgtcttctacagcagacaagtataccaaatttcaacttttcttattagagacaatcagaaaaaaaaatagctgagttga

SEQ ID NO: 706 - DNA, 354 bp, Homo sapiens
agaagacaacttcagtttgacaggtatttactagaacttaccacgcaacaagcacaggaatttaaaaaaagagtaacatgttttaaggaaacctaagttaagtcaactgctcaagtatttggtttgaaacctaggtagatctcctaaatccaatttcaacaatccttctactccatgatcattacatatctaaaaaccacatatcctaatgtgtcctaggaacggtaaacatcattttaaatgctggggttaactataaaatttttactctagaatgttattagaagagtacaaaaaaggctgacatcccacacaaacaacatcttttgtgctttaaggcatccatagttctga

SEQ ID NO: 707 - DNA, 346 bp, Homo sapiens
taatttgagaaaggggaatgtgagttataagtcaatttccaaagcaaactacattcagttcaattatagcacattctcaaatatatcatttgcaagcttcctatagatattttaatgttatcacttttaaagcatgaacacttaagttgagatagtcaatcttgacaatcttttaagaaaacatcaggtaattctgtgtttgtacaacttggagatatgtgggcttaaaaataagcgttcagtggattactgctggatgaacatccataatcattagtagatctacaaaaggctgtgtatctgatcttattctgttcaacatttcctattacaaacaagataaaga

SEQ ID NO: 708 - DNA, 1619 bp, Homo sapiens
gaaagatcaggaaaaatcaccaattagtccacgatttgggcaaataagttgtcttgaaaaacaacaaaaaaaaatgttttttaagtcccatgaaaatgccctaataatatgcaccaaaagaagtaacccatccaggagatgaactaaggagcacggtaaaacagaatgactcccatcacctactaagcaatctatgaatgatacacatgattctgatcacttcagaaggaaataataaccagaaatattagaactttaaaaatcttcatataaagtaattctaatataaatagttaagttgttttctcgtaactttgatgacttctggccaagtaaaattaagatcaaaccactttaagttttctttgtaaataaaaaacatacttaccacaatccattcagcaatgttttcatagagctctggactaaaaattgcttttttaagcctagctagaggaccatcagcatctactaatctgcaccgcatgaaaacatcacagtaacctctaaaatcgttgcaaggggatccaggttgcagggtgatggttcgaccactgaagtgcctactccactgcacagaccctgtactggcacaagttgatgggtccactggaaaagaaatgccaaatataagctgaaggtcagattcaaatataagttgaagatcagatttccagttgtgcaaatacaaagagggaaaaaaaactgaaatcattaccataacatgttatacagaccttctctagttaggctgggtaacgccatcagtaattcatattaaatgttacaatgtaaacaagcaaccagcaagtcttgactcagtgtccacgatgacttaaagtctaacagtgtttatgtaaattactgctgtaaagctggcaacgttttgtctagtttatcatttttaaaacattgtagagaccataataatagagacacaatgctacgttacatttataatctcctcaagaggacagatttagctggaaattatctggccaaactgtaggtcaaagttttacacttaaaatttaggagaaaataatagtttgaggcaaattttatactcttgtgtttttaaaagccttacttttcttcatacagcatacatggcataattctttatcatctttgccatcagaactggcacacgtacactcctctaagccatatttctcacagatagaacctgcacattgctagaagaaaaataaaagacaaattgtttaatccctatacagtcaaacctattttttatagtaacagacaggcaagtatgagcttccaatgtcaaaatatttaaatggaaatgaaagtgaaaaacaaacagagatgagtatcaaaactgaattacataaatacatttgaaaaaatttgaaaaacagtaaatccaagaaagatagtaaatcttttaaagcaatggcaacttaaaaaaatgaaataaaagcagagcaagagattagatgaggatcgattttatgttggttattacggctcttctataaagaaagaaaaattaaatttttttcctgtagagcaaagtgatattcagccacaaaagctttgaaggtttgatattcagagaagatgaccaaagagttcttttatttaggctactg

SEQ ID NO: 709 - DNA, 603 bp, Homo sapiens
gacaaatcacatgccgagttgtacaactatgtttctctagagaatatcaaccacatgtacatggaaagatgaaagacaaattagtagctaattgaatgccacataatatattcatggttttgtgagggaatattacttaaacagagaccaagattaattactttaactatgtagctttaagcatcaataattcttctgaaaaacaagttttctaaaattaaattttaaaacatatagttaaatgcttaccccattaatgcacacttgtgtatgcctattacagtctgtgaagtttggtttagggtcagatgctgggcagagagctgtgaagccattacatattccttcccttgcacagtctgaatcatcccgacacttctcagactttgacttgaatgcacactgtgctgtacaacaaggaccttgacttggactagaggaaacattaagtgattaaacaaagtaaatcactagttattccctatatactattagatattagattagatccacattattagacatagtaccaatttttaaatcctaagtctcatcacttaaatgataagtatgttactggtatacaacttcaaaaaactgaaa

SEQ ID NO: 710 - DNA, 75 bp, Homo sapiens
ccaatcaatcaatcacttaaaagctacagaaggagaagagatttaaaaaggcacagaaaacctttgttttggctg

SEQ ID NO: 711 - DNA, 41 bp, Homo sapiens
aaaaaagaaaacctatttattaaaataatagctgaaaatgg

SEQ ID NO: 712 - DNA, 22 bp, Homo sapiens
agactttatttgtccctcattt

SEQ ID NO: 713 - DNA, 51 bp, Homo sapiens
gcctattttaatctcttctccctctgtagcttttaaattacttatgtattc

SEQ ID NO: 714 - DNA, 36 bp, Homo sapiens
tacttcctgatcaccaggtaaaataagtaagaaaaa

SEQ ID NO: 715 - DNA, 259 bp, Homo sapiens
ggaataggaagctactaagccaaacagtcaagaaaagtgtgcgacttttttttttaatagtcaaagcatactacattccacattcttgccctgttcacctttaggaaaaggctacaatggaaaatggatttaatattaggcaatttatcagtattttttcagttacatcacacattagttaatttatcgctttctctcccattttcatactaaaatcaaactaggatatacagaccagccgtttaaaacatattgaact

SEQ ID NO: 716 - DNA, 176 bp, Homo sapiens
gtattgtgcaaacaattgcttacactgctaccaaagtaaatttgacaagtgaaatagttataacttgccaagttagaaaagtaaatggattccacattaactaaatatttaaagttaagatttttaaaatatggaagatagttacattttcacaataagtaactaaagaatatgta

SEQ ID NO: 717 - DNA, 91 bp, Homo sapiens
aagaatatgtattttttaggattctttttagtatgtcctttgagtatgtccttttgttaacattcaccacacaaattactattaaaagtag

SEQ ID NO: 718 - DNA, 440 bp, Homo sapiens
gtagttcaatctgccaataacagagcagtaaccaacactacttcagaaaaagaaaacaaacaacagataaaagcaaagtttcaaaaccatatgcatctcttaatctcagttttaaatttgtcataactgcattgaggtaactttacaagaatgttaacatcactgaaattagcaaggtacctgcactgtttcccaggtttcagtttgcattttcttccctctggttgatttgcatcgaagcagcattcatctttacactggtcactatagccacaatcacattcttcaccttgttctaccattccatttccacaaataggttggccagattctgaggaaaataaacaagacaaagtaagcattgtgtgcacacattaattttatttaaaattcacaaattctttagatcatcataacaaagggataaaggaaaactttga

SEQ ID NO: 719 - DNA, 137 bp, Homo sapiens
tctagaagctgtaacttgcaacttaggccatgctacattgagctttattgactgttctattcatatcacacaaatacaaaccaagttagtgcttcactaaccaggaaaaaaaaaaattaagcctttttttgcaacag

SEQ ID NO: 720 - DNA, 162 bp, Homo sapiens
cagaccttaatggtattgagccagatcttggttgattaagattagacagtctcatctaagcatagtgaataattttagaaaatttcttcagcagtcttctaaagttctttgatttttgtcaatggaatttaaaattggaatagaaatgctcctctttgtaag

SEQ ID NO: 721 - DNA, 529 bp, Homo sapiens
caaatcgacatggaaaacagtcattgtacaggctttaagttgcgaattgaataagtagaagggaacacatacatctcaacacaggaacccatacatctcaacacaggaaacccacatgaggcctatctaaatcaaaaatgttctagaaagactggctttatattcagataattatttctttatggtaaattatcttcctttatttatatgtgcaatataaaacagaagcttggcacaaacatatgcactcacatcagcccagaagaaaggatctgggacaaagccacttggcaacaggactgggaacccagaccctcagggcacataggagcctagctgaaccctgatttcagggcccccagggatgttgctgtggaggcacctgctctccagagccagactggcctagatgaaagcagaaagttcattcttaaccacatcgactattttttaaaatcttggaggtcatcgaagcttcatccctgtttcactttaaaccatctctttcgttctcaaaaaccagaagcat

SEQ ID NO: 722 - DNA, 142 bp, Homo sapiens
actagaaacatgcatctgcacatatatactaggtgaataatgatttttacaagtctagtaataattttataattcacatgacacgtaatttataagaaaacaaataacgaagtcagaaaatgttacatacattatttactac

SEQ ID NO: 723 - DNA, 50 bp, Homo sapiens
gtacttcaagttagttatttgctaacagtttaaacaacaatgaggtactg

SEQ ID NO: 724 - DNA, 297 bp, Homo sapiens
taaaaatactgtttaaatgcaaaaattataataggtacacattttgttataatttaagaaaaaattttctttcctgttaatacctacaaagcaatatgtacatttttaaaagtcaacttatttcagaaggtttactgtgaaaacccagtttacaaatgaagaatcttaatgtacctgtacattaagaagcattagaaaaacaaccactgacaataacaataacaaaaatgataacatcagtttttgaagattgaagatgtaatttcaatctgcccttttaaaagaaaaagataatgc

SEQ ID NO: 725 - DNA, 86 bp, Homo sapiens
caaaatcccatgcttatctggaaatcttcctgaattctttctcctttgctgtcacatgtttaacccctctttcagtgctcttaatg

SEQ ID NO: 726 - DNA, 33 bp, Homo sapiens
atatttagagtatgttcaatgccgcaagaaaga

SEQ ID NO: 727 - DNA, 1525 bp, Homo sapiens
tacataccaacaaaacagttgtttctcttcttctcaagaacttggcttatatttctaatactacagagtgagaatttattgttgttaagtttgtccccagatgttgctcttgcatacatgatgtaattgccattttctttttgacccaaattcttagattctcctggtgtgcactctgttccagaatcatgctgtcaaaaagaatataaagttacataaacaggaagtaaaataaggttttcaggtcaactgattaaacgtaatgttctcatcaggaaaacaatggaagcttgtggactctcctttaaaaaggatcttacaattgttttacaccttgagtaggaaaagaatttgctcttttaggggtcactgtcttagaaaaggaggaaaatcagtggaggtctagccataacaatttatagctttgtaagcagggactagaattgaggacagactgtcataaaagtctattaaaaataagctcacatacttttaaaactagtaacagtaaaataaactactttaaaactactaaatagtctctaacacatatgttaaattacatgttatgaatagttcagagaagacagaggtggggaaagacaaaagaatcaagagactgacatggggctaaatacacacagaacaggaatctaagacagctaacttaatagccaatatataggaaaggtaagtaaaaatgctgactaggaacagaaacacaatgatatatttttaaatgaaaaatggtaaaagcctagagataaaaccaaaatactgctttgccaaataaacagagttctgtgtacacgtaacatataaatgcacataagtggtgttcggttttgataaattttattgaagagtcagatacatacagcatagctccctgaattttctcaaagtaatgcttatgagaccaagcaacagaacactactaccagatcccagcagcccctaccatcctggggatatgcactaaaacaaccctcacaatgcccctcaaacaattcagaacacatcagaaggggcaaaaaacactggacactagagtaattgtgctatttaattaaaatcttgttttaaatacccaacaaccccactctcaagaaagaaaaagactgcccaaggacgttctgttttttcctagagcccaactaagttactttcattttctattccctcttctgaggcaactgttaaattaaaaaatgtgtcctctactatcacctttattcttcctgatacctcttgcctttcttctgaatctagatgcagcatttagcaactctatactattcaccaatattatcttgctttatgttttcaacctataaaattcaactcagtttctgaaaaaggtgtagcactagaattattctcagcattagagttttagaaaggaaagaaaaaaatcccaattctgtataactcttgatgtcatcacagaatatcttgccacttttcaattcagtaaatattaatgaatgtccagtgctataaaaggaggcactaaaatataaaa

SEQ ID NO: 728 - DNA, 353 bp, Homo sapiens
tttttaaatgatagcaaatcttgacataactgcttagtctgacttgctgctgcataaatccattacagatattgctagtcaattattattttactaggccaggagatattacaatagatcaccattaacaggaatagaaggggaaacaggttgtaagcaagcatgccagctatttgccatcctcagataacgaataaaacaagcacatgaataagcaaaacacaaaacagaacataaaggccatcttgactggactcgcacaagtattcagagttcaaatcaagagaagcgtttcactaagaaactataatctttgtgacaagaaaacagaaaaatttgtctaactataagaa

SEQ ID NO: 729 - DNA, 369 bp, Homo sapiens
ttaaaactttttggtattataaataaaactatgatggtcatattttcttaatttttattaagggccatattcatttacatcatataacaacacggatcaagatttcaacaggcagacatgggaaggaactgacttcctagcggaggaaagttttaaaggtctgtgaattaatttgacagatgaggagagataacactagaaatatacttaaaccccaaattatcaaacaccccaaacattaagataaggaaattgtatcagcaatattagaaagtagtagaagtgagttagtaagcagaagtggcattattagaactgtatttacatgaaggtgaatctggtgagagtaggtacatattagaattttca

SEQ ID NO: 730 - DNA, 184 bp, Homo sapiens
cagataggataaatacatttaagaaataatgtgaaccactcagaaaaagtaacattgacattactacaaacgtataagagagaaagagatttcagataaagatgttaagggagacaggttcaggtgtttatgattctggctgatcttactattaaattactcaacaaatatttattaagcattg

SEQ ID NO: 731 - DNA, 222 bp, Homo sapiens
accatctactacggatacagatggcagaattaacaacatgtgcaaaagaatggggtacgattgagcgtggtaggcaaagagtgtgaaccaatttctccattaaacaataatataacattaattgaataaaaacatctcactggcagctaggtaggaaagagattacacaagaagtgaaaagagaatggtctagattccctactgcagtgtggttcacagatg

SEQ ID NO: 732 - DNA, 585 bp, Homo sapiens
gagtgacctgggactaaaggccagacaagtagctggaggagtactaaaattcccctggtaaggcctggaaccaagatgacttggggagaagagaggacacttatctgctcttgaaaatgcaaatcaactatgaacaataattctctgctcatctctaaaattccaagtactcttttaagagaagatcacaaaagcagtcaagagttacagagattaagcacattttaaataccttatccaagaacattaataataatctatcaatttctgattgggatgtagaagaagaaagacttgcaacttagtgagatggcacctattttacaaacatgggaaaaattagagaagtgcatttggggattttaagctacaagtagacaacttatttttaaaatcataaaaatttgcacttttgcaagtgataaggtgaaagtaaaatgaatttacatacagttttcaagtgtacattttcaaaatgttatctttaataagctctaccaaaatcacaaagacagagtatcattcagtatttcatatttctgtgttgtactgatctttaaggtcacttaaaagatcaatataatg

SEQ ID NO: 733 - DNA, 101 bp, Homo sapiens
gatagagttcctttaaataccttagcaaagaaaaagaaatacagatagaagatatgtcaaaatcttcacaattattggctctgaattaggggttgacaaag

SEQ ID NO: 734 - DNA, 269 bp, Homo sapiens
ttctgaatcatgggcgtataacgctttgttgcactatttgttctacttttgtgtatgttagaattttttcctaataaaagattttaaaatatcaatctcattccacggtagagaaaatactttaaattatcaatctcattccacagtagagaaaagattttaaaatatcaatctcattccctaaaaatgctttaacagaaacaaaacaaaaaaagaatttctcacaatttgctgaacattcaaaatgtacttttaaacaatgaataatg

SEQ ID NO: 735 - DNA, 914 bp, Homo sapiens
ctagcactgttatgcttacttttcttactttaaccacaaacattctatcttcctccctttcagtatggtcaaatacattactgtgctctgacataaaaactaaacactcgtaagtacatttgttttcacggtgaattttaaataaatcactcaacataaaaattagactaataagtattttttaagctaataattagacaatacttactggggatccaaagttatgtccaacttcgtgagcaaaagtaatgtgagagactttgggaggtacatgagacccatagttctgaacagtaataattccagtgtttaaggacttcttcttaccatctgaatagagtttacttttttcacatattcctccagagcttcctaatccagaacaaaaaaatggctaaattagtatctgtttccccttacccccaaaaaggtaatacatgctatattaaatgaaaacattttatattttaatctaaaatagaactggtactcaaacgtatcacatatgcaaaagtttctttggtccaagactaagaagtcacttcatataaaagttttaatgacattcagaaagaaactcccaggactgagtacacagcctttacaaaatgttcttcacaatcaaaatgtcccccaaatgttattcccattaatttaggaaaacaaatatttacatttcctttcaatttgaatatatcagtatttacactaagtcaaagtgtacatcctttcatcttttaaaaagaaatcttatgatttaagttaaatgaaagttgaacaaaatatcctcaagaagattctgagaaagtcacttctacaagaagcagtgaggcacatgagcacatgattccctgtcctgagatatgacatacaatgtatttgtaaaaatagaaaataatcatgtcaagaaggtt

SEQ ID NO: 736 - DNA, 123 bp, Homo sapiens
aaaaaaaaagagggggtagaggaaagaaggaaaaagagaagatgggtgggaaggaagggagagatagaaagcaaatgcgacaaaaggttaataattgattaatccatcaagaattcaccactg

SEQ ID NO: 737 - DNA, 66 bp, Homo sapiens
catgaggacaatcacacccaccttactgggagactggaagattaaaaaagaaaaatgacataaacg

SEQ ID NO: 738 - DNA, 978 bp, Homo sapiens
tagcatgcagtcagcaaacttatccccttccgtcacagtgccataactcagtctacagacgagtaactcggggagggggtttgtttggctcatctgtaaaacagggctgctggaagccgacattgcataacccatatgtacaacaactggcacacagtgagtgctcagctgttaataaagggaaggaaaagaaactgtaaatctggctctgttataggtcctgaggttaagcaaatagagagacagttataaagataagtaagacaagagagccaaatgtaaataataatatcaggtaattaattagatgtatgaacaaagttcaaatcagtgtagcttccaggctatatcaattacctcgcttaagccctctacgccctttacaacacaggactgtcacccctgcccagtttacgggccagccaaggcgggttcagaaacagcagagaatgtcctttgggcttacgctgtttgtgaccctgcttcttctcggatcctagtccatcttcatcttttttttcccaaaatggttttctcatttctgccactgaagttgaacaaattcaacatctgatttttcctttccctgtctcccctctgcccacaccctcccccagtacttcatcttcctgaggtcggctcgatcccaacttcatgtctgtcccatccgccctcttcaattccactctcctctctccagttatgacccctggatgcctgaagaagccttctaactgtgctctccactgttcagctctgctccctccaatctgccctgcatgagcccctgagggatctcaccctttcagcaggtccacctacaagtataacccctctaggtgacataccttccttcgggaagcttctcccagcaaccactgacccacaagaatctctgctttcctcaaacacaagtagacttcgcaactctgcctacctgttagaataacctgaagaagcttcataccacactgttca

SEQ ID NO: 739 - DNA, 68 bp, Homo sapiens
aaataaacctcccattcctatcacttcctcattgttcaatatggcttcatatatttcttcataaataa

SEQ ID NO: 740 - DNA, 47 bp, Homo sapiens
agtgccagtgtgtgaatatatgagtacctgtaagaatcagcaaaaat

SEQ ID NO: 741 - DNA, 633 bp, Homo sapiens
ctgatccacagcagctgtcatctataaccctaaccctgtgtcacccctgcagatgaggcttcagtagctcaccattacctctacagacattctaaattcaagttaaataacgcagatgaaggactcaggtgagtctgggactttctgtatcagaatcgtcacagatgcctcaaaaaatcagattcccagaccccgttggagacattcagatccttgcagacccctgccagggaattaatgagttcaggttcattccacatgcagattctcgggactccctccaggaaattaaattgagattcccggatttaaccccctggaaggggtcccaagaattcacgtgttgaacaagtgtcttttctcagacacgctgaaggtagggatctacagagtcacattcatgcaaggtctgtggcacaaggcctggctctgcctgcatctctggcttcatctctcaacattcatgcccccaccctgtgcaggtccaccaaccccggctactccacgtaacagaaatggcctttccctactccttctcttggcttctgcaaccagcctcccaaccttcactcaggtatcaaagtggcaagcttttctgggttccgtgtctattctgagctcccaagcctccta

SEQ ID NO: 742 - DNA, 116 bp, Homo sapiens
actgaacttgaaaaactctgctatagtctattgtcatgtgagttcctcgaaggcagggaatgtgtaacactcacctgcataacctcagataccacatacagagcctgacacaccgt

SEQ ID NO: 743 - DNA, 340 bp, Homo sapiens
tatccgtaccttacatctggcattcaggtgtgttcatttctgccctattttattccagaaaagacgtgtagatacttaaaaaaacttactcaatgcaacaggataaaatcagtgaaggtatcgtagaagcagcagctatgatgaagctataggtgggttgagagcagttattaggattatttttatagccacaaggtagagataagctgaaatttgactctgggcttctggttggcatccatgcaataaaaatgtcccagttgctcaagggaagcacagctctctctaaagttgagaggtgtggggcactgggccatagtgagagtgaagtggacaaccc

SEQ ID NO: 744 - DNA, 125 bp, Homo sapiens
atctggacaaccctttcaacagcaccaatacaccaggagtctttcacaactagttgttataacttcctctgagttcttttcctcttccagaactcattctctttctctttcccatgtaatttgat

SEQ ID NO: 745 - DNA, 208 bp, Homo sapiens
gtttctttctatctcttaagtttgagcttggccacatgacttgttttggtgaatgaaatgatgatagacatgatacaagtaggagctttagatgtgtttgtgcagctggatgtgaattcctgaatctctcccatcaccatgagaagagcatgccctggctagccctctggttcaaagaaggtaaaaaaatacctggagtcaagctcat

SEQ ID NO: 746 - DNA, 713 bp, Homo sapiens
cccattattgacaatgggtaaccaaaatatctcccaatagcaagttaaagaattacgccaaagcgtggctaaataaataaatgaaagcaatcttttggggggctaagatagaccaaattattccatgttacttaagattcctcccaaactaagtagtaactccttggtgatagatcatattcttccaccaagtgaccaccactgagctgggcacataagaatgcttgatgccaatgtgtcaatcagtatttgattgggaatatagccaacccatttcaagagaaatgctgtgaactaaagtcaaaatgttggcaacactgaacaatcaatcgactgaattggacagtcaatagattcagatgctctaaatgccttccattatatccgatctgccaaaggtccaaaaaccaatgatgcagtggcaaatttcctggtctcatctcccacgcagcatccactctcccccagatggttgagttctttctggtcatcttagatccctccagaatggattttttttacctctcatgcttgcgcaaggctcaacttcaattcgaagaaagccttcccatacttccttttatgaaattacaagcctgggatccctaccttgtctgctcagaaataaaacagactcagccccatctacacttgagttagagttgagagttgcatactctcaactcctcatgtggctgagttgctaaaggtgt

SEQ ID NO: 747 - DNA, 97 bp, Homo sapiens
ctcttatcacttgattttgaattcagagagtagacccatcacagcagagctacagtggggtggaaaggggaggtaacggaggtaacaggacccacta

SEQ ID NO: 748 - DNA, 197 bp, Homo sapiens
tagcagctgtgctaagcactttaaatacactctctcatttaatcctcaccaccacctactttgtcaccattgcttctataacaggacatcaagtaggaattctccagttgttctggatcaatgactacagcagacagttggtacctagctcagggtgagagatccccaagagaaattgctccaaaagagggtgatca

SEQ ID NO: 749 - DNA, 586 bp, Homo sapiens
tgtcatggtcaccagccaattatatggtcacctgccatggagccatgggggctgattgcaagaaggaggggctagcatctctatccctgagctgcagagccatgagcccctctagtgcgatcatctgagtaagatggagtgaggacactcttggaaaagctgactctaagcaaagcttaatgtaggaaaaggacaggggcaggcatctccctctcattccctgtgccctaagagtgcgtcacagatgcctgtgatttcatggtagaagaggaagccagagatacagatgagaggctatccaaggagccactaaatgaggggcttggggccacagatgattgaaaggggccaaagggaggcaaggctggccttcccctaagggtctcagtgacagatggggcacatatgacattgaaaccaagcacacgatctacaccagaaccatctcatttgcaaaggttttgagcagcaaaaccagtgttacacagaacaagatcagaaatgccacccataactacgaccttgccaagttaagtagaaataagcctaaactccccgacccactttcctccccatctccacacac

SEQ ID NO: 750 - DNA, 122 bp, Homo sapiens
tttaatagctgaaagtggccagaaagttaagggacctagcacccactggggtagaaagactgaacatacaactgataataatatttaagaaaaaaaacaaaactagttcatgcttgtacccc

SEQ ID NO: 751 - DNA, 246 bp, Homo sapiens
tgtcgtttaatagacacttggtgctgagtgctttacatattttccttttagggaaaactctgagacacatgggctcaggggaaatatttgttgacttggatggaaaaggcccatcctcagcttttgttttgccctgtcctgctgtctgtctgtgttaagttcaatgcctgaggctttgccaacttatattccctgtaagggcagaaattcagctcatgtaaacctcacagcaatccttatgcccat

SEQ ID NO: 752 - DNA, 442 bp, Homo sapiens
tgccttattgagctgtctcctcaatttcatcttcaccagccccaattctcagatgtcccctgggcctcctcaataccatgttgcaggccatagccccaggctgctaaatggcacgcagcctctgtgggagaagactctaattgtgcctgaccacaaggtctgcagggagttaataaattattccaagagaatatttgcactgaaggccttattgactggagtccatttcctgagttggcataattttttttctccagcaattgttataaagcaagtgcaagtcttgaagcctcaactgtagaatctcttgattatcaccaagtatatgggcttccaagcctacctaccttcaaagtcaaggtcatcacaaagggataatccctcaggcaaaaagaaagatgagttttaggggtcccctggtttccatagaaaaggcactcca

SEQ ID NO: 753 - DNA, 113 bp, Homo sapiens
agaaaaggcactccagttccattctattctttatggaactattcataatttacagattaatgtcacttttctccctcccaccctcatctttctccctaagaaaaccacgactg

SEQ ID NO: 754 - DNA, 19 bp, Homo sapiens
cctctctaaggctgagaag

SEQ ID NO: 755 - DNA, 94 bp, Homo sapiens
taaaattattccaaaacaacgtggtgatttctaaaaatatatgaatttcatacacgagtattatgacatgaacaaaaagcaattaaaggtcatc

SEQ ID NO: 756 - DNA, 211 bp, Homo sapiens
cactcctccaaccagggcaactaaccactctgtacctactctgaggatggcttttttatttagttattagtttgggacattgttaatgttctgtaaagacaaatataaaacaaaatttgaaaacaaaaacagaaagagccacaatattgggcatgaataatccaaatctgagcactgtcaccacgtgctcctctcaaattcagggttttaa

SEQ ID NO: 757 - DNA, 542 bp, Homo sapiens
tcaagttcaggtttgagcagctctcaccaaaatcccactgcagtaaaattcgcagtgggcttcaaattcaggtccatctgagtccagatcccaaaagctttctgacagatcttcttgagggtgacaaaacagaaataaaagatcagaatgggaacttgcagttcctcttctgtcctttatagaagtgtcaacggggatgcaaagatttcattatcaacgggactggcactgtgcccttctatcaggcgtctgctctcacagggaaatcaacttggcacagcctcaagcattgaacctaacactgagaggcagccgggcagagcagaaagaaagctgaagacaggccctttccatccaagtcaacaaatatttcctttgagtacgtgtacctcagggtttttcccaaaaagaaaaatccctccccatataaaccccctagaaagaagtcattgctgcctcaaatgcatgtattcagctgcaaggcttctattgctacatgctttctgattatagccaccatttctaagccctgcaggtgtttg

SEQ ID NO: 758 - DNA, 40 bp, Homo sapiens
catctccagagcctactattttttttcggtgtaaacagta

SEQ ID NO: 759 - DNA, 63 bp, Homo sapiens
ttccaaaatcaagtacaaaatcaaaaggcagattttcaaacaaaatctttgaaaagtggttct

SEQ ID NO: 760 - DNA, 272 bp, Homo sapiens
atatataaataaaaataaaagtggttctgtcctgcttacaccctcttctcacgcttttcaggcacaaagaagggccaagagcaagagaggatttctttggagagagtctgttgaagacacgccttcatgttacaagatcttgaaactcatgggcaccatggtctgggatctgaatcctgcagcaaagctcttccaggcttcttgctatgctgcctggggtaactgcacaaggccccataattagacgaccccactgtgatgctggcattttg

SEQ ID NO: 761 - DNA, 23 bp, Homo sapiens
cccaagatgcttattttatttca

SEQ ID NO: 762 - DNA, 105 bp, Homo sapiens
gatggttaatgggtacaagaaaaatagttacaaagaatgagtaacacttactacttggtcaggtgtggtggctcacacctgtaagcccagctctttaggaggcca

SEQ ID NO: 763 - DNA, 774 bp, Homo sapiens
ctaagtccacttagacaatcagaggtgcttgttttaaactcaggttcctggaccccactgtttttaacagttcagcttgatatccaagcctgtaagagacactttgattctctggattaaaatgagagacagtgagaggagaggaagaagaatagaggaggagagatttctctctaaaaatgtaagggattccaattaaaaatcacctctcattgtacatgcagaaaatgtacagtgagacacaaagttgggttggaagacaaaactctgaaactagtctgggagggttaagtgacttcatggaaataaatactaaaatatcaaaatgctctaaactttccatttttacttctaaatgtgctgagaaaaaaatctgattatttgacaggaattttaaaaagaacaatttttataaaactaaaatcacattcctgaacactcaaatgcttagcataggggatgaaattgacctggaattttctttgtgagaggaaggaccaagttcccaatgtggatacattaccagttagattttccaagcacagttcatactgcagaattcacctaacttgatttaggtttctcctttataatcagtttccacttgaacttcaactaccacgaaaaagtaagtaagtaaagcaaagacgtaaattcttgggaactttgttatgagaggaactttctagactgcacttagttgtcttatttaattagctaccagggaaacaaaacatatagtatgtccaaggagttgactcaatggaatgctgt

SEQ ID NO: 764 - DNA, 68 bp, Homo sapiens
tgcgaaaactcaggaatcgttgaaagggacttgttatgaacaacaaaagatgctcccctaaacccatc

SEQ ID NO: 765 - DNA, 27 bp, Homo sapiens
atacttcttccttcatcgcagaggtta

SEQ ID NO: 766 - DNA, 66 bp, Homo sapiens
aatttataattcattcaacaccgttctcaaggctaggaatatggcagtaaacaacagattggccca

SEQ ID NO: 767 - DNA, 546 bp, Homo sapiens
ggccagtggtgcctctggcatccccaaaagcaagcctccaataccacaaaggtacacagggccactttccctgcacctctcggctcctgatctacccaactccagaccccaaggttcacctctagctctgaaaaggagcacagcttctccagccacatctgcctcattttgcctcaactgcaattggaatcgttctctgattggctcccctgggtacgtcccctagcctgaccttctcaatcccccacttctgtgccctaccatccccttaagtgacactgtcagccaggtttgcctggctctcaagctgcaaatctctaagacagaagtcaatgggtaatgagaataagaaaatgtgaaggactagaactccagatcttgatgctactggtattagttaggtcagagaagataataatttgacatcctaggaacccaaatttccatccccgtctaactccactatccaatgctaaattcaatggcttataccaatgctatttgattcttaatcagtgtctgctccatctggtccctttacagtac

SEQ ID NO: 768 - DNA, 36 bp, Homo sapiens
cttttaagtaacacagctcaccctgcataaacatta

SEQ ID NO: 769 - DNA, 121 bp, Homo sapiens
ttgagccaccgtgcctggccagaagtaacattttagatgtacaaatagcaatagagatggaccttacagctttaatgagagtgaggagggggagttaaaaaaaaaaaaacaaaaacagcat

SEQ ID NO: 770 - DNA, 31 bp, Homo sapiens
catgcatcaatctttttcaaagtgtacacat

SEQ ID NO: 771 - DNA, 47 bp, Homo sapiens
ctacaaataaaacttaggatggaggactttcaaaagatatggattca

SEQ ID NO: 772 - DNA, 74 bp, Homo sapiens
acttaaagtataaaataaatgagatattgattcagagtcatattccacaattaataactatattaggaataaac

SEQ ID NO: 773 - DNA, 27 bp, Homo sapiens
tgaacccagagacaaatcagtgagaga

SEQ ID NO: 774 - DNA, 49 bp, Homo sapiens
cctgggtccttgcagagacccatgtggatgtgccacgagcctgtgatcc

SEQ ID NO: 775 - DNA, 78 bp, Homo sapiens
ctaggatctgcttctggttttcaattcttctattatttaagtcatgcaacagtgttaaccaggcaggctcactagcat

SEQ ID NO: 776 - DNA, 776 bp, Homo sapiens
tggacacatggatggatagaagcaaaataaaatcaatactgtatgagccaaacaaaacaatggcttgagcattctgtttctaatgatgctctcaggaatgcagccacaaggaaactctgccctcacctccaccccatgaggcagaaactggccaccagtgacagggaaacaaagtggattcctcgaatgtcattgttattaaaacaaaactagtcccagaaaactgacctgaatgtattttttctctcacttttggcctgactgtctaataaccaaaagtcaccagaaaaaaaaaattttttctcagcaaatgcttaaaaacagagaagacccccaaagtacacaggggcagagaacaactcacaaatctcaagaataaaataaagacggaagattctcaccctactgcaatgactctcccagcccactgccaccaaagtttctgagattaaaaagagaaattatttaatatatgcagtttcaatttttaaagtttcaggcatgaaagagcttttgctccctaatgatgtccctcagatgtagcaagacctggtctctctttcactgaagaattgccttcattttcaccacagacttcccttgcctcaaagacagatgctcagtcagagaaaggagcctgaggatccatagaaactctctgatattaattgatctgctcctagttttcagttattctattttttaaaacatgcgacagtgttaactaggcaggctcactagcatgatggatggatgagtgagtgggtgggtaggtt

SEQ ID NO: 777 - DNA, 216 bp, Homo sapiens
tgggtggatggatggatggatggaaaaatggatggatgtatagatggagatagatatagacagaactagatacagacaaatagagacatcgttaaagagagagaggtaattatttatttttgcaacaagtatttattatctactttaggtcaggcactgctccagcttataactgtttgttataacagtaaccaaaacaaacaaacatccactacc

SEQ ID NO: 778 - DNA, 660 bp, Homo sapiens
tgttcaggttcaatattactttttaaatagacagacttaactacctgagaaaaaaacaggcatatcccaaaaatactaggacaagggaaaattataaaagttgatttaacaccaacaggtatgtaaaggagatgatgacataatgcttagttcctggcaagatttagattggagaaaaatagcatgacatgggcacacttggaagaaaccaatgggctatcaccaagaaggacctgctcgagctcaagataaccaggaaacataaccaccccttatgttataataatgtggtaacacaaaaaggtgggatggcatgtcacatattgactcggaagtaggcaaaaacgtgagaccaacttgggcttagatacacatacctaggaatatactaggtgaagtcaaagacagcaggagattgatattctacataaatatggaaatgcactttatgagttcttgagaatctctggggatttttcataggtctcacccatcactggtcatgtaaatatgtcatttttagcaaaatcacattctcttcacttctatctgttctgtattgctgcaaggactgctttttgaactagggtatgacaatgatccgtcttgatagtgtttgtgagtcaattcagaattacagtgattactaaagttggtcac

SEQ ID NO: 779 - DNA, 160 bp, Homo sapiens
gctagactccttgagggtgagaaactatgtgaagcaaggtctggccaatagacagccccaaatgccagaattgggagtgaagtcatcatagacaatctgtctctaatggagtccccagatgtgtgcagaataggaatagccccaggaaagaccaacagaa

SEQ ID NO: 780 - DNA, 133 bp, Homo sapiens
ttttggataatttgttatgcgggaataaataactaatacagatggtagctacaagtctcttcctatgcctatggttgtcaagtagacaggtgaagcaattagtagtggaaactatccattcattaaacaagta

SEQ ID NO: 781 - DNA, 536 bp, Homo sapiens
acacacagcctagtggctcacaataagcaacctttacagccactgcttgatgaaatatctccagacaaaagtattcctccaccatagcataaggtgatggtctgcccttgtgtatccatccttgtttaagaaacaaactaatgtcccttaactaaagattctccttccagtgaggacaaatgcaactcctcgtgaccactgtttctcctctggtgcccttccaataactcagaaaatctagattattggttgtttatgacttcactggatagcacctctattgtcatcaggccttcaggaggttgggtcttctgagaaatgcctgcccctcacccagccctagcaggccaatccattcctctttgtgtggtggagtcacgccagtgaagtggatgaggagtaggatgggagtcagaaaacttaggtttcatttgtgcattctcagacttgtgggaagatacttcaccagccccagccttagaaatgagagtaacagagctgtacaatctctgaggtgttatgtattcttaaggata

SEQ ID NO: 782 - DNA, 362 bp, Homo sapiens
tttaactcaggcccatccagtcttaaaaacatggactgaaccagtgtacatccaactgacagatgagtttagaagctatctagtccagacaagcttgaactcagctagtccagcctttcatgcacctcacctatttagtgacagggaagtcattacttctccaagcaacttacattacgttaggctgaaaattgcctgcctgaaattcctgctcactaatccctcttggccctctgttaacatcaataattccaccgataattacaaagcacctactaggcaccagacattatcctaagtgcttgggatacacgtatgaaattgctcattccaacttggtttggcccagttttcaagggttt

SEQ ID NO: 783 - DNA, 298 bp, Homo sapiens
acttccctagcctttcctcagagcccagctgctgtcatttttggggggtcctctaccaagtctcttgaattccacattccctagcctttcctcagagtccaactgctgtcattttggggggatcctctactaagtctcttgaatcctacattccccaacctttccttaaagcccaactgctgtcattttggtggggggtgggggggtcctccaccaagtctcttctctatttccttctaatttttcgcaatggtcagtacacccaagaccctctttccctgagctgggaaaagacctc

SEQ ID NO: 784 - DNA, 66 bp, Homo sapiens
tctattaaataatagtaatgtcaactattaaacctgcaccttggcatatgatatgctacattcatt

SEQ ID NO: 785 - DNA, 24 bp, Homo sapiens
agtccccaaaccaacacgcctttc

SEQ ID NO: 786 - DNA, 36 bp, Homo sapiens
gagcagggtacctagaatccaagttcaggcaagtgc

SEQ ID NO: 787 - DNA, 722 bp, Homo sapiens
taccttctcttccacaaccctgaaatgcatgctggacagtgaccatcctgactgggacactagcctggccctctgggcttgcatagcaattgatgcctggctttccctgtgcaggtggtgctgattaatggtgctgttaagaagagatccagctgctgctttcagtttcctcttcctgcagagatccttaattactgggcttcacctgttgagtttccttaaatgacatgagtgtgtatttttaagtgggaaaacaattcattaggaagtgccaacatctcagaggaggtaaatcctccagttaatttcagaaccacactgcttcagccacataagagagcggtccaagggggtactgcttttttctgaacgtcaccaagccaaacaaccaaccttcagcagatggcagggagcggccttgagaaaccacagggaggggtcatgagatcaaaccacccttagccatcaacctttagcatcctccctggttgcccctttagctcagcaccctgggaatgatgggtccacacagccatttaggtactgcttccacacggctgaaattgcatttgcattttattaaataaaagcaatctgtgcaaaagcctagcctaaagttactaacagatatttgagtctaagataatacatcttacagtattagaattcaggttctaagacaatcaccctcaaccattgtcaatctttacattagggtagat

SEQ ID NO: 788 - DNA, 157 bp, Homo sapiens
gctagttgttttatacatagagagagagattacaaaatactttctaaaggatagatcctgggtcttatcactgtattgctcataccaagcaaaatgcctggcacagagtgtgccaccgatacatgttttgtgcataaaaataaataatgtcacttga

SEQ ID NO: 789 - DNA, 112 bp, Homo sapiens
tgttaatatgtcccttgattcttgtttgtacctttttccaattatttagccttacatatatatccatgtatatataaattttacataaatgcataaaaagtgagcattcctt

SEQ ID NO: 790 - DNA, 277 bp, Homo sapiens
cggcaaactttttttgctaccaattttggctcatttgccctgcccctctattctcacccccattgccatctccccacctgctccaacacctgccccaccagaaaacctgtactgacagtccagtcagtggtcttctatatagtgtccatcctcatttaattctagacagccatacagacacacgagtgtgggcaatcattgttttatagaaatgggatcatattctaccaaccgttcccatgtattcaacaattccttgttgtaagccctccaagtt

SEQ ID NO: 791 - DNA, 1095 bp, Homo sapiens
gcccccaatacccctgatatcactcaccttcactgtccttattgggcacgtaccagtccataggtggaagccccattgcttagtcagccactcccccatggatgagcactcactttgcttcccatttctgcccgtcagaaataactcagccacaaacaggaggtcatctgatgcctgcaaccaccctatacagcacaaatatccatgtgaatctttcttcccatccgcagacacatagccaaatgcctagcaggccttacctgaccccactaaaacagtctttctggccagggaaaattataaagaattatatgagatcacacatacaaaaaaaaaaaaaccttcacagtgtgcagaaggctttgtgtcaaagtcgagctcgcacgtggccgtggccgggttctctgtggccagccccattcacaacacagctctggcagagcactcttcaatagcatcattaatagcccattgatccaattacatttctttctgttccacttcagaattacaatctcctgttccccctgaaagagcccagatagattcccagatgagtatcggaagaggtagctgccatcaggacttgcttgatggacccaagcactcatctaatagtggcactggaagaattaatctggctgatatatcagacctctctcctccgtgggaacttgccattttctccagcctctgagtttttctagtgagattcagagatacagccaaatgtgagttaacccagggacatcctaacactgccctcattgtgtgttcccagcatggggtaggcactccataaataatcgttgaattgaaaaatgcctaaggaggggtatattggggctcaaagcagaccaggtcggctgaagaaatgggctttatccagattgtgactttgcaggttggaccagaatgagagtttgaatctgattccataggtaatgcataaaatgaaaatatatactataaaaaggcaaagtcaagaccttgaatgatagctgagaaaaaagtagagagagctaaatacatattccaagtctaatgggcaggataatgagggacagaggtaggcagcaataggaccaaaatagc

SEQ ID NO: 792 - DNA, 168 bp, Homo sapiens
aggatgaggaagaattagtaatgttgaatactggcaggtgaacaattcatactgtgagaggctgtggccccagtacccttgcatctgctctagactttgacttctacagtgagactcctggccaatgaggatctatgtccacagtccctgggggtcatcagccctgca

SEQ ID NO: 793 - DNA, 354 bp, Homo sapiens
gattatgtttaccaggttccaggtaagtggaaggaaattaaaagacagcccagctggaaacagtgggcaggcattacaggcaggcccagctttctaacagctatcataaaactggctgctcgctggagctgtgaatttcccatcgctggttagagaaattctttaaaagggagattcttttaaaaatggctgtcctagatgatgtctaagctcatctaattttcactaggttactacaatggagaatggttgatgagtaagcaaagacagcagaaacccactacacagtgaaataggaatagatgtgtgttattgtcaatgtgattgctcttggttgaatgatgagatcagggg

SEQ ID NO: 794 - DNA, 97 bp, Homo sapiens
tttaatcaattaaactaaaagatccattctcagagaaataatgacagtatgtcatgagcaaggattataactaacctaattctaaacatccgaggat

SEQ ID NO: 795 - DNA, 356 bp, Homo sapiens
tgagaatcatttttaaagtttgatttaaacaatcgcccatccccagatctgatttggggcatcaatggggccaaatgacatgggtttcctagagagcaaatctccggatgtcatacagatacttaaaaccttcaatggctccccatttccctacaacacattcctagtcctcagcttgatgtttgaggcttttaataatatagctcttgccagctgtaccttacacaacgccagacacactcagaccagaggtttcaatctcaagggcatatagggactcagtggagtgtgctgggccaggacaaaaccacaagggcatgccccaactcaacaactgagcaacttcacaggtccag

SEQ ID NO: 796 - DNA, 242 bp, Homo sapiens
ctctatgatttacttagactctattttttaattacttagatttactaaaaggtgctatgctcgcaccccttcaaatatccctccccgatgtttcctctctctaggttactcctctctgtctcctttcctggatttattccagcccaacctttaagactagcttctagttgcagtcattcctgcagaattaccaatttctttttactcttccatattgtcacaatgttttacaatgaacctga

SEQ ID NO: 797 - DNA, 196 bp, Homo sapiens
ccacagttatcttctgctagactttgtttgctatcacacacctgcttgggtttttcctggaaacacttcctattaaactggttttaaatgagccctcatttcaggatctgcttctaggacctttgatagacagcttttgacatgttctccaatgatctccagcatcttctctgttaatgcccttatacaatcccct

SEQ ID NO: 798 - DNA, 187 bp, Homo sapiens
taattaaaaatgagttaggtgagacagaaaaggaagtcactgtaccatggccctttgagccagagttgtttggtgccaaaactctgcctcctaatcactacctgtctctccttttgtcctttctccatcttctcctctcttacctctcaaaaattatcaataatttgataattctgtggttagaatc

SEQ ID NO: 799 - DNA, 288 bp, Homo sapiens
tgatgtagcctgatctctgcaaaagcgtctggagtctctccagttgaacgatcgctgatagaaactcacgggaacagtctgtgccctcccggcaagtccacgctcattcgaggcagctgtcacctgctaggacattccagggcacgacttgaaaaatgcttggcgtgcctctgacaacaagagatgcaggctgaagcaaggcattcctgcctcttgtcctgaaactgggatgctggcattagaatggacagcatgagttgttcttgagtggcaaaaggcaaggggtcc

SEQ ID NO: 800 - DNA, 889 bp, Homo sapiens
gatattatttcctcttcattaaagaacagcttttctaaatgttgggggaaatgtccatagtcattactcaatcaaaacttgtgttcccataagcctaaggaccattctagattttttacatgtttttttgtgtgtgtgtatctataaaatgcatacataaatttttttttgtttttaagcattcacccaaacaaaaaatcacaggtaaacccatatttctgagatgccattattccgagctaaataagagataatcacttcaaggtaaattgaaaattttcctgaagccatacatttcaagtgaaataagtaattctaaataggacaatttaaattggataattttaaagcgtctataattggtttatttgcaaaattcctgaaaggaaaaattttatcactgccatcacagcaggtttccacatccagatgagaaaacaagacaaatgctagtgtgttttaactagctaaacaaaactaagttaaatgaatatttaaaaatttccctagtgggccattccttaacaaaatgttgaaatccctgttgctacattgactaaaagatcatgttgaatggaatatgtaagacttggctcatagaaacctaatcagatggttagagatgctggcagtttaggacctgctgccataaatgtgtgaacaaccttttgtaatctaacctactgacctgcatgttttttctttaccccagctcattccttacatgtagcctcaatcttcagtttgctttactggttcagcaaaagccaggaagaacaactttgtagtaatcagaatgttatccaactgtatattgtttactttatcgtaaatactggtgaacagtggttaataaatagttttatattcctttatgcaaaaaaaaaaa

SEQ ID NO: 801 - DNA, 80 bp, Homo sapiens
gggccccatgctggtatacagatggcactgctgaaaggagtcagcagccccggcccttgatggagacgctgaggaacgag

SEQ ID NO: 802 - DNA, 171 bp, Homo sapiens
tgtctcaaaaaacaaaacaagaacaacaaagacaaagacacgcagagtgaatgtgaacctgtgtatcacggggaagttatttgaagatacatctcaacagctatggaaatatcaagccctttgtacacagtgattccacttctgagaatctaaaccccaaataatccaaca

SEQ ID NO: 803 - DNA, 144 bp, Homo sapiens
acagcaagatgagttaatttttgtagcacacacacaaaaccataatgtgtaatgcaaaattataatgtgtaatgcaaaactaggttgcaaaagcaacccaattactgagatgacaggagccagcacccactgtcccccatggcc

SEQ ID NO: 804 - DNA, 69 bp, Homo sapiens
tttttgtgcaataacaatggtgtcatatatgatattataagcatacgctttttttttaaatctggagga

SEQ ID NO: 805 - DNA, 255 bp, Homo sapiens
ttaaacattttcaaaataaaaatgtttttaaaaaatccagaggaatacatactaaaccgttgacaatgattctctccgaaggacagagggagactttcctctatgttgtgaatttctgcagtgtttaaaaaacgtaaactttagctgaaaaacgaaactgaatatgccatatgaacccacttatataagcaaacctaagtcaggcacatgaagactggaaggagctctatcgaggtgttattaacagtgactgat

SEQ ID NO: 806 - DNA, 406 bp, Homo sapiens
gtgatcatttctaggtggtgggataattgagcagtgtttggctttttccttttgagggaaaacctctacaatgagcatgtatggcctcttcaaaagataacccacctttaatagcttctttgtgttaaccgggtgatgctcagggcgtaatgctctgctgatgtaacctgctgttgatggtgtcctgtttccccaggatggatgacatccagctctgcaaggacatcatggacttgaagcaggagctgcagaacttggtcgccatcccaggtaaccatttgcaacttcaccttgtgctaaacaggtgcttgggggcccccagcctggcccatctgtacgcctgggtctggaagacagagcctcattcttgcaatgcagtgctccctgactgcatgtgtcaaacaca

SEQ ID NO: 807 - DNA, 40 bp, Homo sapiens
gtaagagggtctaattcattgagtataaatatcctaaaga

SEQ ID NO: 808 - DNA, 202 bp, Homo sapiens
aaattaaatatcataaaaatcgatgagatgatgcaaactaagtgcttagcttgatatttggcctcaagagtccagtaaatattagcaattatgaccattattatcctacttgggaacagatgaagtgtgtacaaactctaactttgaagtcaccccagatttggtagttaataatgcctgacttatttggcatcttctccaa

SEQ ID NO: 809 - DNA, 20 bp, Homo sapiens
ttatcaaaatgctagtccca

SEQ ID NO: 810 - DNA, 60 bp, Homo sapiens
aataggccagataagcacccaccattacccttgacttgaatgtttttgccatgctgtcag

SEQ ID NO: 811 - DNA, 98 bp, Homo sapiens
ttcttactgagctacaagtgcagcatgatgagccttaaagcagcgtttcccaaccttcaactattgacatttggggttgacaaatgtcagtatcttcc

SEQ ID NO: 812 - DNA, 33 bp, Homo sapiens
caagcgaggtcaggggggtgtgcaacattgccc

SEQ ID NO: 813 - DNA, 30 bp, Homo sapiens
gctcccacataagaactactactttagtaa

SEQ ID NO: 814 - DNA, 175 bp, Homo sapiens
cacagtcttgttgtaagggtagtgtgcgcaatgacagtagaactgaatcctctagctttcgtgagcatttactaggtgcccagcactgtgtaggccctaaggataaacgagtgaatagactttcctagttgaaagagagcgacagctagtgggtatggggtttcttctgggggtg

SEQ ID NO: 815 - DNA, 156 bp, Homo sapiens
taaagctgttaccaaaaaaagttaaatgtcaaacataaaacaacgaaggaatgagggaaaagtaccaaagtctattctccacccactagaaaccccaatgcaattgatctggcattgttggctttggactctggcattgtaatagaactcaacttg

SEQ ID NO: 816 - DNA, 26 bp, Homo sapiens
ttcctaatcttctggttaatttgtta

SEQ ID NO: 817 - DNA, 24 bp, Homo sapiens
cctgatccatctcagcattagtaa

SEQ ID NO: 818 - DNA, 143 bp, Homo sapiens
caggcctgttcccctctctcatttcacaattctccaaggattagtctggctgaaaggtacagaaacccatccaagcttatgtaagcacaaaacaaacaattactggaaggacagtggagtctcctgaagccctagggcattac

SEQ ID NO: 819 - DNA, 124 bp, Homo sapiens
agcaacttacaaattactttggaaatagagtatttccaaatagaagagatataaactggggaaaactatttccaaatagggcacacatgaactttgggggtgccttagtctctgtggcttgctc

SEQ ID NO: 820 - DNA, 1064 bp, Homo sapiens
gtgggtggcacctgtaggcaagtggaagatgatgggaaaggtatgtggcacacacgcacgtgagcagcattggccaatgacttggagacttgggctagtcataggtctgtgagctgacgcaggccacttgtgtgagtaggtggtttctcctgggagttgctgcagctgaggctggggaatgcctctattggtgagtgacagaacacatggatgaatggcttggagacagaggtttgcagatgttgggggcccagccagttgttgggtgattctggctaagatctagagagcagtggagggcacttgggaatgtcagagtgctgtcaatggttatttggagagtaaagtcacaccacgagctcctgagtgagcaggggtcctggtgagtcgatgggtgttggtgcgtgcttggagagggcagggagcggctctgcggtgctgacgagtgatttggggaatcagacccaacccacaagatttaccacggcaggagcagtgacaccatcatccaatgcaccaatggctgggaatggggagcggctggcaagcctattgcccttcttcgtgcagtggtggactcctggttaatgagagaaaccaactttctgtcctatccaaatattatgttctccttacccctggttctgcttccagatccagaaaaaatgatcaacgtcagtcgtgggcaggcagacaagctgtcccacattttttattctgaagggatttgagcagaaagagcccaagtgggtttaagtttttgcctcttaattttctcaaacctcatcttcagccctctctcttttttttattttttctctttggcatcctagcacttggtgtttgggacagggttagtgtcattggcatggatgattttcttctgataaattggtttaccttcaccaaagggaaaaaaacaactagttccctcccagcacccctatctgagcctctcctcaccccctgcctttgcagaagaccctggctttgtcatgaccatttactgaaggctctcagccaaggccaagcactccactaagccatttactaacactactgca

SEQ ID NO: 821 - DNA, 29 bp, Homo sapiens
cattactcccattttaagcctcactgtgt

SEQ ID NO: 822 - DNA, 30 bp, Homo sapiens
gtggtcaccctctcatctgtctctctgtaa

SEQ ID NO: 823 - DNA, 303 bp, Homo sapiens
cctcagcctcccaaaatgctcatctgtctccttgttgatgtcttctttccagaaaaagaaaaaaccaaactgcagaagcagagagaggatgagctaatccagaagatccacaaactggtgcagaagagagacttcctggtggacgatgcggaggtcgagcggttaaggtgagtgcactgcgggtacccgatcactgggctgcaggacagcaaccttctgcttccttccagaacccatcttctgctcctgggactcacagccttgcctaacaggcatggccttgatccacagtctctggacact

SEQ ID NO: 824 - DNA, 80 bp, Homo sapiens
acacagcagagaacgaactgacaggattcctctcttatgtaactcacattcttatatgataatgataagggttaacatta

SEQ ID NO: 825 - DNA, 184 bp, Homo sapiens
caccacgttatgtgttctccagcccatggagaataattttaacacagtcaatgaaatttctacacaacaatgttcttgtctcaagtccaagaaagccataatactggctttctggtgagtaaagatgccattctcatgtgtaatcaggtggcaaatggagatatgaccaaagtaaccctttgcc

SEQ ID NO: 826 - DNA, 165 bp, Homo sapiens
ctcagttatatttatgggtatgttgttgatatacatgttccaaaaattacatacatttatacaaatttaatatgttatgatttgtaattttgatagttatactaaatatttgttaaagttatatttgtataaacatgttatgaatggctgggcaccgtcactcat

SEQ ID NO: 827 - DNA, 376 bp, Homo sapiens
cagtaagtacattttttattatcaaaaaagagtagtgtatgattggcttattctgtgtagaatgtattttatcgatggcttctatttttataatttctgagttaagtaatttttaatgaatgctttttagtttggggcagattcagttgactaaagcacctcatttcccagatacatgaaataaaatatttggcttcttttccaatttcacactgatgttattttgtgaaaatcagtgctttaagataaatctttatactttaaggtaaacatgagaaacttgatctaatatttaatatttattcagttctacactttattaacttctacaccagcagatttaaaaattatgtaactatctcaagaagtttcactt

SEQ ID NO: 828 - DNA, 488 bp, Homo sapiens
gtttcagcaaattccacctaagaattccaccagagttctgttgtctccaatgtcatgttccacagatttcaagttgtgaagccctgaactgttaatttatcttgagaatgtacatttaagcttaatttaagactatatacctaaaaattgagcatataatttgtataatttgtttatgtaagtttttgtaagtcataagtatgtagtttccaagtatataatttatctgaatgtaataggcattaatatattttacattattgggaccataatacagaaatttctaaatggtttgtaaaataacttgttatttgcaatgttgtaaaagtagttaatacaatggaaaaactcataataagaagatacattttaacatcaagaagtttacccaaggtaattatgaatactacctggcaaactttacagaagctgtggtatcacttttatgatagaagaatagtgtttgcattttgtgtaaaagtacttgg

SEQ ID NO: 829 - DNA, 96 bp, Homo sapiens
gcagaagatgaataaataaatggatgccactgaatgagatgaggtctctcttgaaggagagagaaaaagagatttaaatagtaacaattataataa

SEQ ID NO: 830 - DNA, 244 bp, Homo sapiens
taaatataaaaagtattagagtcctaacagaggaaagtttccactgatcaccttttagctttgaacaatgcagaagcatttgcccagtttacttgtaattaaaaatcatgcatcattcacaatttatcagtcttttttgtttgtacaaaaactaatataagttattctcttttgtctgtattgtgactggtttggtgagagggaattaggccactcgagagtttgtgtgtgtttaaaattttct

SEQ ID NO: 831 - DNA, 448 bp, Homo sapiens
ctatcacagcataaagtaggagggatatttcattactgtctagttaaactggttaatgcggaaaggaagtctggaaattccagttttaaagtaaaattttggacattgtaggattgattatttggcatagctgtgatgtttgttgctgcattatggttttgttggcagggcagcctttaaggacctgtatattttcttctagactctatatattccccgtcagtattagttgcatggtcaaactggcaaattttaccataggtataaataatagagaatgtggaagaatagtgaatagtgtcagagatagttaaaggtccatacagaagtagagaaggtaataagtaatagtggcttggactaaatatttgttgaataaattttttaaaaaacagcctacctaaaatttgtgttgaagatatgaatgaatgaagtttccgcaccctta

SEQ ID NO: 832 - DNA, 167 bp, Homo sapiens
ctacccgagacaccttaggagatttgtaacagctgtaatgccaggtccaccatatttttagcataaagcaaatgtttacccatgatatgactgcacaggctttcagctggagccatagcaactcaagtagtaaccctatcttagtctgattaaaagtaaatattagt

SEQ ID NO: 833 - DNA, 512 bp, Homo sapiens
ctaatatgacttaatacattcattttggagggcaagtctctcaaaatgggcctttcactgggggaaaatggtaaaaatactccctggtaattcaagaattgcagactcctgagatgctgctcatattagctgaacacttaccaatacttcacttttttccatatatactcaaggaacaagtgctatttaaagtgtttcactctgctgtgctaggtgcaagactataaagaggtgtgaggatcaacacttttatgaaaaccaacgtcattctgaatgtagtttcagatgctagtgcaaaggaagttcttggtatacggaaaaagtattcaacaataaattaggcatggttgcttccattttctgcctcacacacttttttttcgtggttaaagtgataaaacgtctatgatattttagattggcagttgcaaactagtggtcctcagcgggttttttatgacacctacaaggtttgaagactttgatttcatattaaaaatctgggtttcagt

SEQ ID NO: 834 - DNA, 85 bp, Homo sapiens
attctgggtttctggcatctcaaaaaaaaaaaaaaaaaggaaaggtcagggcagctacagtcctctattaagcaatgtgccacag

SEQ ID NO: 835 - DNA, 662 bp, Homo sapiens
tgctttagaatctgcctggaatctgcagcctctattatatagttccctatagactttgcttcctaccatcttacattctgccttataggcatttgtgtttgcaactcttgcttttgtcagtatgctacgctggtgacattgaccaaattgaccacacattaattataagcttagttggtgatgacctcaatggaataacatgacataagtattgtgacactacttcttgcatgtatctgcaggtggaattgtaaacctggtggtccgagatggtctaattcgatcttcctatgtatctccttatattaatagtggtaacatttgtggtggtgattcagcgtttcaatgcctcttctcatggcaacaacaaacgttttccgtctgaatcaacattaacctagatgttactgcggatcagaattagactctacattttcaaccacagaaatattgggcagtaaacatttttcttaatattgattgcctacataggttgtgtaattagcatatgtttatagttctatgatttgtgcatggctgctgcagagctggagggggtaaagcaacagtgttttctcagttgtgcgagcagcattacattataatgaataggtaatattaaactgggctgataagagttgcaaaagactactttaatgttc

SEQ ID NO: 836 - DNA, 176 bp, Homo sapiens
taaatagggctgatgaatcatattacagtaatccaatatttcccttgtaaagtccctgaggtttacagaaggaaatcttttctaataacaaaaagagtgaggcatgtgctttggtctttatttcctagttatacgatcctgggtaaggagctcaacttttctctgccaaaattaaa

SEQ ID NO: 837 - DNA, 129 bp, Homo sapiens
atctctaaaatagagattgagtctgaagatccacaaagtggtagaaccgatcttaagattcccaaataatagaattgtgctttatttgcctaagtagtatggtattacttattgtatgcccaggggatc

SEQ ID NO: 838 - DNA, 104 bp, Homo sapiens
ttcccttcttaaatagttttaagggggagaagaaagaaaaagactgattttcttcccttccactaccaaaacaggcaaaacacaccagaacactttgcttagca

SEQ ID NO: 839 - DNA, 77 bp, Homo sapiens
gtcccatcattttttaagataaattcacataccataaaacttaccattttattttctctctcttttctctttcttcc

SEQ ID NO: 840 - DNA, 1432 bp, Homo sapiens
ccccatgccttctgcctctgtggctttgcctgttctcggtattttgtgtcaatggacccatgcatgggggtgggccgggcacctttcaaacgttcagcccccaggacggcccgtggcctccggattggacggcgcgagctgggtgtgtgtgggtcgctcaatcgctccggagcttctggagggggcagatgcaggtgccggctgctgcagtgcagtagctgctggaggctggggaggcccggacccggtgcaggaagacgccgaccacgcgggctcctgatcgcgggcgcccacagcgcggacatggcgggctggtggccggcgttgtcgcgcgcggcccggcgccacccgtggcccaccaacgtgctgctttacggctcgctcgtctcggccggggacgcgctgcaacagcggctgcagggccgcgaggccaactggcgccagacgcggcgcgtggccacgttggtggtgaccttccacgccaacttcaactacgtgtggctgcgcctgctggagcgcgcgctcccgggccgagcgccgcacgccctgctggccaagttgctgtgcgaccaggtggtcggtgcgcccatcgcggtctcggccttctatgtcggtgaggggccgggaggggacctggggggtgggacccagtattgggggactggaggctgggactcggggatcaagcggctggagggagggcgctgcaggagcctggggacccgggcaggagccggggctctgagaccggagctgcttcagaggcctgaagggccagggcaaaggctagaggctggggtgtttgattgcgaaaatttgcaggaggcactggctggggagccgagaaattggggagccagaggtccaccaggtcaggaatttagaggactagggtcggggctcagactctggggttgggtgtagaccaaggctggaggtaggcagggctgcggaggtctttgccccctgaaaaaggcccacgggaaaataaaggagatcccagttcaaggccgtagcagctgcaatgaccgtgaaccagtcgtgggacagggaaggaaccgacctgctgttcagaaaatccacgcctggggccccggggccaacacaggaacaaaatgcaaggggatcagtgaccctgaggggcagagcaggtggaatctgaggttgggcctggatcttcagcaaattcatgcccaggggcctagtcctggtttggtaacaagattttcccctggggtctcacggaaaacatcaagggaccttggatccttgccatggaggactatatacctgtgagggttcagggaaccctctccttagaaaatccgacccgggcctggggtgtgggggacaggggcttgactgtggaaaccttctctactgcatacaataagaacaatggaaatggtacctgaaaaataccggggttcat

SEQ ID NO: 841 - DNA, 562 bp, Homo sapiens
ggaggggccctgtggcctctagcatcattgcgatttctagagccttgaaggggatggggtgggtaactggggagaaaatctctacgggtctcaagcctgaccttgggattggggatcacagatctccccccaaatgggagggaacttctcctaagggctgttggtgctttctaaaccaggttgaagtcagacaagccaccatcttgaagaaacctaccctgccccgtgtgccttatttttaagagttggattcacttcctttccctacagaccccaccagaaacacaaaccacctggttgcctgttgtcattgcggccaactacatggctgacggggtcagtgggtcaggagagcaggcagcctgagagctagggcctcctgttttatcagaaggtctgtgcctgtgcccggtgtgtgatttgcagactagatttgcaaacagcttcctagcacctgttacaggaacctggtacactggtgaaggggtaggggaccagaatgctatttaatcctcaaacaactagtgagattgttctctttttcttcttttttttttgagac

SEQ ID NO: 842 - DNA, 157 bp, Homo sapiens
atccaggcacttgatgctctcatggtgggaagtttgacagtttgcctgaaactgaaagatgctgagttactaacaagacttgaacctaagtccaggccaagctctctgatacagattcctggccagattgcagctttgctttggtcttcagtttttc

SEQ ID NO: 843 - DNA, 213 bp, Homo sapiens
ggttttcagtttttctggttcagtttcccttacctcacatttcaatgaaaggggaagtggaaggggatagagtggaggtttgcgtaaggctttacatggaaattgcaggaatcaattgatctttgtgctggggctaccttggggaaccagagtcgtaacagattaacaactctggcttgggaatcagacacctgggttgaactctgtccgcta

SEQ ID NO: 844 - DNA, 200 bp, Homo sapiens
tttaattaatgctgggtaagtggaacacagtattaccaatattttgctgggtcatgtaagaatcgtctgtaattaactaataaagctcttatattccctccctcctaatcagggattggaaagaatttttaaagtactctcagttttacaaccttcctaaaataggagagctttgccttgctacctgaatttattgttac

SEQ ID NO: 845 - DNA, 133 bp, Homo sapiens
tgaatttctcttcagggatattgaagatcaaagtgtttttaggaagggtgaattggtgttccactttcaaattttgaatagggtaatactgatggaaaatttgtagtcgccagagtatttgggtccactggcc

SEQ ID NO: 846 - DNA, 240 bp, Homo sapiens
cactagcttttttaaaaagacagaaattaaaatttcaaaatgttcaaatgttcaacatttcacaaaatgtttggaaggtagagaaagtaaccaatagacccactattgtaacctgattgtttttgtgaattgttagtttttgaaaaaataatcgttctgctataatttttatactctgctattctcacttcgtatttatcattcctttaaaatttatctagttttagagtggagattatg

SEQ ID NO: 847 - DNA, 251 bp, Homo sapiens
tctatgttctcttttcactgttgggtcagagggtcatattgttggatgatagtgatggttactttgcattttggaatgggaaacttaaacatgaactgttatacggtactctactgaatcttttaaaattttttttgggttttgcaaataggtatgagcattctccaaggaaaggatgacatatttttggacctgaaacagaaattctggaatacctatctggtaagataggcgtttgaaaatgtaatcac

SEQ ID NO: 848 - DNA, 40 bp, Homo sapiens
gataatttgacacgtgtttaatcacatcaggatttttttg

SEQ ID NO: 849 - DNA, 170 bp, Homo sapiens
aacattaagtacatttttattaaactattcctaaattagagctccagtttggttgacagaagggtccaatattttgacatagaaatcttaaagttattttgatagatgtatgaggagaggttttaagagtatctgtacttctcatgaactggaaagaaataatgtctctg

SEQ ID NO: 850 - DNA, 410 bp, Homo sapiens
gaaataatatctctgaattttagtccatgttctcagtgatttctgactttattatattaactcttagtaatgatcacaatttactttgtaaattttgcagccaaagggacaacaatttattctgtaaatttgggattctatttgcaaaatagagattatagattgtgagtggcttaatggaatcattcccacattcagagccaatgttttcaggtgagcatcctgcggagtcctggtgaaaagaactttaacatcacaaaggtattgatagagaaggagaaggtttccaagggttattccaaggtttgaagcaaatcagcatttttactgtttgctcggcacaaatatatacagtccagtccaatacatatttattcattgattcagttaatatttattgaacagtgtcc

SEQ ID NO: 851 - DNA, 38 bp, Homo sapiens
attatgttgtaaagtctatggagatatgtacatctaac

SEQ ID NO: 852 - DNA, 60 bp, Homo sapiens
gagagcaggaagtagaattgggaaagaagcttcaggcagggatttgtaaatgaacaaaac

SEQ ID NO: 853 - DNA, 284 bp, Homo sapiens
tctgaagttatgcacatactgggggacaggtcattccaggggcagaagagctgagtacagttgacaatgcgtaaagcaccatggtatgcctggaggggagaaaccacaggcagtttggtgttcacagagtatttgttgagcaacttggaatgagtttggatcctggagactgttgaacacccagagctgaggatcttgaacttcacagttaggtaatggcagcaaaggaaaccaaagtgggtggttatcgtgaccaagttcacataagaaataaggaagcatat

SEQ ID NO: 854 - DNA, 27 bp, Homo sapiens
agcacagaggagagttcatggcagggt

SEQ ID NO: 855 - DNA, 63 bp, Homo sapiens
atactactacatgatactacattctgacaagaaaaaaaacacagccataagaaataaagccat

SEQ ID NO: 856 - DNA, 63 bp, Homo sapiens
agaaagaaggaaagccatgtttggataagtttagtcttctgattatttttgctaaagttttaa

SEQ ID NO: 857 - DNA, 34 bp, Homo sapiens
atattttatatttaaagcatatttaacaattaag

SEQ ID NO: 858 - DNA, 334 bp, Homo sapiens
gcttttattgcaattgttcattttagaaacttcagaaaatacaaattagtaaaaagaagaaaataagtctgtaataccacttttaaggactattttgaaaacctctagctgttttttgagataaatttacataccaagacttttttttaaaaaatcataatgatgactttttcataggactgtgtaggataaagcttgtgaaatgtctatctaacatattttgtaatatatgaaaatttcagctaaacttgttctatagcatcacatggtttcaatatattattagaaaatcattccataaacaatggtttggtatatagtttcaacaattcaa

SEQ ID NO: 859 - DNA, 379 bp, Homo sapiens
ttaatttaaaaaaaaagaattcattgatgattctgtatttacaaatatattcctgcatcatttgttcatggtaaccaggaaattgcaatgcatatatacatgctgtcatttccaaagccgctgtcttccagaattggtactgattctagtagacttttcattctggtgttaaaaatataattaatataggaatgtcttctacctaatagcttttttccccacaactccccaaccccctcactctagaggccttaagtagtctaagttaatcagcttagtctgaaatataatactacctaggcatcttgttggcctagtatttcttactcttttatggaatgaactgtgcaattgttttgtgtggttaaaaggtattcta

SEQ ID NO: 860 - DNA, 830 bp, Homo sapiens
aaataaaaggcaatctaataaagttgttgctttttttttttcccaattccagagtggactgatgtactggccctttgtacaggtaagttccacctactcagtaatatgaactcagggctttggtttccatgtggccctaacggactctctctctgttccagctgaccaacttcagccttgttcctgttcaatggagaacagcttacgctggagtctgtggttttctctgggccaccttcatctgtttttcccagcagagtggtgacggcacattcaagtcagctttcaccattttatatacaaaggggaccagtgccacagaagggtacccgaagaaatgagaagtcaaggactctcttaaagggaccacattttttacctaaaatgcacagaattgcctgcagacaaaatatttgatgtgccaattatgcacttcattttgaggaattactactatttatagacccactttttaaaaaattatcaatgattatttttgaattgtattcagacttttttcctgttctagtctgaaatattacttctctaatattttggttaatatgaataatagtggcaaaatggcattttagaattattaatatttctaatattttaacacaagtttcaggaaacttggttttgattgttcacatttctattctaaaatctcaggttatctcctgaacacttttgggcagatgaagttttataccaaaaaatagttcttagagtgaattttaatttacatagaactcaatcgaaatgaagatttaataaccagatttctttctccaaaacatacacaatttgttattttagtaaatacc

SEQ ID NO: 861 - DNA, 361 bp, Homo sapiens
cagtaagtacattttttattatcaaaaacagagtagtgtatgattggcgtattctgtgtagaatgtattttattgatgtcttctatttttataatttttaatgaatgctttttagttttgggcagattcagttgactaaagcacctcatttcccagatacatgaaataaaatacttggtttcttttccaatttcacactgatgttattttgtgaaaatcagtgctttaagataaatatttatactttaaggtaaacatgagaaacttgatctaatatttaatatttattcagttctacactttattaacttctacaccagcagatttaaaaattatgtaactatctcaagaagtttcactt

SEQ ID NO: 862 - DNA, 389 bp, Homo sapiens
gtttcagtaaattccacctaagaattccaccagagttctgtcatctccaatgtcatgttccacagatttcaagttgtgaagccctgaactgttaatttatcctgagaatgtatatttaagcttaatttaagactatatacctaaaaattgagcatataatttgtataatttgtttatgtaagtttctgtaagtcataaatatgtagtttccaagtggataatttacctgaatgtaaaaggcattaatatattttacattattgggaccatagtacagaaatttctaaatggtttgtaaaataacttgttatttgctttgttgtaaaagtagttaatacaatggaaaaatggtttcgtaataagaagatacattttaacatcaaaacgta

SEQ ID NO: 863 - DNA, 155 bp, Homo sapiens
ctcaaaacaaacaaacaaacaaaaaactgtacccaagttaattataagtactacctggtgcaaaactttacagaagctgtggtatcacttttatgatagaagaatagtgtttgcattttgtataaaagtacttggggctgggcatgatcgcttat

SEQ ID NO: 864 - DNA, 146 bp, Homo sapiens
ggatctctcgagctcaggaggcagaagatgaataaataaatggatgcaactgaatgagatgaggtctctcttgaaggagagagcaaaagagatttaaataataacaattataagaaggctgggcgcggtggctcatgcttgtaatc

SEQ ID NO: 865 - DNA, 3310 bp, Homo sapiens
gctcatcaactcagctgctccataattagctggtgatggctgattgcctgccccatggttgggaagcctgggcactgggcgactgcaggggagggggaccaagggatgacttcttccaggaccttctactctctccaaccagaggtgccctctagccctgtaaacttctgcattctccagcacagttcctgagaggttcagaagttacctgggtcctggtgctctgctcctgctacctttcagctcctgcccccaacaccctgttcaaattgggaacaagttgaccacagggcacagtgaatttgaaagtccggagattaagtcatatgttgaaagagggcccagtgagcaggggccactaatcccctttcttcctcaacctaggaacctcctcccttcccaagatatagatatatatagattgagaccctgagcaatggatctcttttgaggccagtggagaccaagaccactgaagcaaggagtcagggactgcccacaacagcaaagctccccagagtccaggccaccccatggtgattgtttgggttccctgtgattgcctcccatggctgccctcgttcatagagagttgactgcatttgcctgggtccctgtggggtgagagtatggaagtatgtgtattagtcacaccttacaccagaccagaagatatacagtttaacctaggagtcaagctcctgctatatttggaatggtctcagttttgagacgtggtaccttggatcccaggtatatccaaagtcttgagagtgtccattgaggactttggtctgtagccaccaagaaagagtaaacatttgtgcaggatcatgtttgatgggattccatggattgttttcatttcttaagcagcattcccctgagcctttgacatgtctttccatctctggctgtgttctcacttgcatttgccaggcctgcaatgcctctgccttgatacaacacagtgtgccagcagctgcagtcccttttcagccagggccatgggtttccttgggtccttctctctggctcacgttttccagggctgttggtgtgtacagtctagagatcacattttattaacacaaagaaatctgcttgggctgcctggctcttgcagtcacgtggagagaaatgtgttcctttggtccttcagcctgcagcactctgtgcaaaatacagcagagagctgggcactgggccaagcttacatttcacttcggaacacactttcgcatcactccttggcagaacatccacggtggtgtctatttggggagtaagttagagaagtgttgtttgcctcttatgagtgtcgagagataggacctttagaaaatgttttacttttgcgcctgtcttcatcttcttcgcggtgcccaggtactgaggtgatccagctaaatgtggcagtgatgcctgagagaagccccttccttcctcgggccacccttttctcttgcaaaatcagtaaacagagccaggactgcctgggacagggaaacttaggccaaggtaataacatcaaaaccaaagtcctggaactcttgagtaagctagttaccctcccagataaaacaactttgttgtccaaatcttctttccaaagatctaagacctttctaatgttggtccaaggccagccatggaaggaaggaacttcagcaagccgcctggaatggcaaacactgttaaaataaacaaatggacctttgccatttggttttccctgacttgtctatttttatttcttttctccccccacccttgtactttacctctcgatagtacccccctttctccacccctactcccattctcatctcacttttctcaggggccaagctggctgttttgccttcagtaaaacaaatatctaatttcaaaaagaggaattaggagaaagaggtggtataattcatttcttggggtaatctcgcttccctcagctcctctattgtctgttcttgtaggtggccacctgaagcttgacttgcttttgaaaataaagttggttttggaattttaaaccttccttaggaaagacttgaatggttagaaaacaaagatttattggaataataatgacgtttcttttctcaatgaaatagacccctctcataacaaacggttgaaaataaactctttttccccatcacaccaagccataaattccataaggatttcccagcgccaagccttattcagagtcttatatttactgctttggaatgttacttttgccatcagtatcatccagccaagcaacaaccaatcaagacttacagaaacttttccagctagatgcatgtgccaggctgcttcttccttccatgatggaaggcctcccttgtcatagaggatgcccaaaatctcagggactgggatacagcctcctgccagtctgtgggtacagtctttgcttactctgcagaagggaggtgacagaaacccattccacctgtctcagaaacctgctggtaattaactttaaaaataatgccaagttctcacgtggctggtagatgcattagctcaatcaggggggaggcaggggagaagcatgctgcttcaaagagtaatactgttgcaatcacattagtcattccaggggaggttagataaggttattgaaaaggtgaagtcaccctgtacattgaaagaggtcttctgaaagtgttgagaaatagttgaagttcagaagttttatttggagctttgctcccccttccccttgtaaataagaccagtattttttaaaagccacattttctttgtttgatcgatgaacactctcatagttgatgattgagagtcatctacagccagtatcaagggtcagttctgcattactcatgtgtagattatctctttggtatactagccatggtcactgtgtaagccctggccagttgccacccagcataacaacaccataaggcatctaccccctgcctgcacttgggaagtgttcagggaatgtaatttcattttataattaagtgaaacaatgcacagtgcatttccttggtggattctaacagcaggacagttattattcagaaaggactgtgtctggactactttgagaatcagtagtttaagttgttgcacctgtgtttggcctatcctcataccagtgtaaatacttcaatcctgcaagattttctcattttgcataaaacaggtgaaggtttgttgaagtccatcttccaaactcccaaagtactctggataccttggtaggtccttgtggactccctgttgttgacttgcaagtttcccagaggtggggactggcttt

SEQ ID NO: 866 - DNA, 228 bp, Homo sapiens
gtaacaaagatactaatttcattagaaatggtttgaaatgagtgcttgtgttggcagaattttgtccaacatggttggtctttgcaaagggttatgatagtatgatgcacgcctttgggccagatgtgagtcaggatggtcttggaggaggcgaagtgcagatatacccctgctgataggctcctcataatacttcagtgagctgtttttctcgtgactgtttcacta

SEQ ID NO: 867 - DNA, 33 bp, Homo sapiens
agtttcactgttttctgattggtaaacattcaa

SEQ ID NO: 868 - DNA, 249 bp, Homo sapiens
tattcaagaatgaagagtgttttcagagaagaggatttagatgcttacaaataaaagtggatattgaccccccaattttccaccctttaatcacagagacatgattggaagtcagcagctccagcctgcatgttcccagatcacctgtaagagttcttaaaactcatcccacaggttcttaattgggatttttaactgggtaagtagagaagctccatgttgggtgtggggaagggaggatgcagatgg

SEQ ID NO: 869 - DNA, 1100 bp, Homo sapiens
catcaacttatgtttctttggttaatagatgcaggagaatgcctcttctctccatgtggcatgtcagggtatagcttctttgagcacaggatttggtttacagaatggcatgtctccccatgccagccagtgataaggggcactaaaacagacttggccttgctaaaggcttccaagcaccaggccatgagcagttgaccccaccacagaggtatgtacagctggcaggaagctgcccttctggttcactgactcaagagttggagcagattgatccctggatttgcagtgccctcaatatcgctgcacagaattcattctatgtaccccaggccctatgtgcccacagcaggaaatatagtgtgagcctctggcaatatccagagttgcttgagcctcctcacatttgcttctcctattcagtttagtgtgcctcagtttactaatatgctggggaaaataacacccctcttgccaaggtgagatagcagagttctctgcataaaatagtgcataaaattattcctatgacaaggcatttgaaaaattactttgagaatgacttaaaatacagaacaatttttttaaatgtggcaaacatccttattcttatcacccagaattaacaattcagtacagttgccatatattcatatataaatttacctatatattcatatgtgaatctagacattgcagattcacttgggggtctcagggaactttttataaaaagaaatgcatttagttcgtaaggcctgattgagataattccaagtctgttttctcagctcttaatccttcctagcactttgcattcattgtattaataaataagcctgttttcagcctagttagaaaaaaaaaggccagcctcattcattagaattctgcgttccctttggttattctttgttggagagaagggggctcactggtacagaattccaagatatttcgctttggaatgtgaaaggagtctctcttgacaacccaaggagaacctgcctcagaatgatctttcttcctcagtgctggaaaatgaaaaccagacaaataagcacaaccaacattaacagaaggccttggtacagcctcaa

SEQ ID NO: 870 - DNA, 251 bp, Homo sapiens
tttttttaattaagatttgaggtgctatatgtgcctgaggagttataggggatgccggtggaacgaccattacatgtggcagctggactgggcaacggccgatcgccactgtgctctgaggagagaaggcagagcttccccctttatctgctggctggtgaagtcctgagaaccgggcagtcagctaagcaccaagttttctctgactacagagctcctatcaaacggatgggtagaaaaggaatgttgtc

SEQ ID NO: 871 - DNA, 2497 bp, Homo sapiens
tcatggagccccaactcaatgggctgcttctcagtagaaggctttgccttgtggaaggtagtagaatgtctaaaatcatcagaacacctgtgtggatggtacaacacggtgacagatatgtaccagggacctagatgtggagggagtgaggaggaaaggagcaacatatgcacctctggggaggccctaaggtctcctcagccaattcctagggaatttaattttaaaggacacagagagggtagtttttaacacaggttttacttttaagtcatgagggatgactttctaagccacagttccttctgataacggtcttaaaagagaagcaccatgaagtgataaacacatcagtccaggaagatttagagacagcctagtagaggaggattggaaacagtgtggctgtgtccctgagggtgctggtgctaaacccacggcacagtccatatcagtcaaagcttcattctccttgtgcccacactatgctgatctgccccagtgcaacagggagacgcatatggtcaagagaatgtgtctttcacgaatagattttctccttcgaccatggtgagaagtccttgtaaagaagcatacatgaatatatggatgtgttgggcatcagctgtgcgtgtggccctcagccaggtgagtggaggaagttggaggcattcagtgttcacctccatgtgcttttcagagacatacctggtgagctgtctgcagatacacagcgtagtgggagagatacgcacgtgaaagcagcacagggcatgtagctagcacttggtaaatattagtttccttcccctttctgtgtgtaaggcaagttgtacgagcaaagcatccgcagctcagaatgcaaaaatagatctccatgtggggatgtggcctcttttccccaagtgtggaccagatgtcaggccgccttgtgagtactcaaggaatgttacggcttccttcttcaggacttcactgcttctctccatatggagaaggctccctttccatgcacttcctggatctgaaaaacaagaacaagaaagaggatggctctaaagtctcaggaaatggacctttctatatcctcccttttaaaaagcatttgtatgtaggttttttaggtcttgctgtcaagtcggatacacagctgtcatctgttatatcggtgatttaataacataataaaaatttatagagaaccacaagctcatggatgtttgttttggagtgcatttattcatcattagtatgggtatttttaatcatttactgagggcctagcaaggtgctggtaattcagagataaggaagatgtcatcctttaaacttgagaagcttatgaatggcgaagagatataattaattgtgaatggagtgtggtagatagcatcaggttgtatatgaggtagaatcaggaaagcaagaatggccagctctgaatagagtgaggagggaagatgggagatgatccttgagttgtgtcttgaagaatgagcaaaaattatattcatggaaagaaaggatacaatataagtgacttgttgagtttttcttggctgatactaagaatgaattttcattaaatatgcaccagtaattcacaggaaatgatcaggtcagaatgttatgggacattggtctgaaatataatgagaggggaaaaaaacagaaaatttaaaacgtttatttatgatggctaatattcagaggggctaactccctcctgcccagataaggagaactttgccgcctggcaagggacctgcggctctgcactgccagggcaacagaaccacacgtctcaaacgtggtgtttaaagaagatgttggaaggttagaggcggtgtaatggatgggatttgacagttgctgtggcaacacacccacttccagaacattagtgttagtgggagggcaggcaaactcgtggtacttgccctgggctgccctatgtcccgtaccacctgttctatgccaaaggtatgaacaaattcaaaaggacaaatgcctcacatggctgatggctgcctgcctttgtagaactgaccctggaataagataagaagatgagtaaatcagagaaaagacaacagggaaatagcgtggaggaggagggggaggccagagcaagcagtgttaactcctttcaggtcaacatttcccagggttatattagaatgtattgactaactggtagatttttatggggaaaaaatgcatatggcatctgtgtgtctaaaatgcccttgatagaagcagtagtgtagaatgctttggggcataaatagtccttagagtagcaaaaagacaggttaatgcaaaattggttggacaggttttggttggaggcctgagtgattgcctccggagcaccaccttctggggagtcatgggtatgacatggtgtgaatattcctgaggtgtgggtggttggtttccttacaaggtagggtttgcaagctccttacatccacaggggctgtttcctctggac

SEQ ID NO: 872 - DNA, 154 bp, Homo sapiens
gaaatttaaacattttattacaaaattaatatacgattgttgtaaaataggactgtataaagagtaacttgagttcccatattccatttccagatttaactgtccacagtttctgcgtactcttccagacgttccctttgtgtttataagcatt

SEQ ID NO: 873 - DNA, 769 bp, Homo sapiens
ttacatatgttcttatctatggccttagatagagggtgtaaaattaggagacgcagctcccactgatgatgcctgggtcatgtcctttcagatccaaattgcaagatctcctttaatgtggttaattgggagaaattgaatgacccatttcttctgaaatttctgttaaactggaggtctttatttagacaaatgtaaacattaatccatctttattaagataatgtatgattaaagcaacaaggtaccatctaggttctgtttgatacttttcttgttattctgtagttatttgttcataaaccattttttcttcttataggctttcaaggaagaattatctaattccttttggtgtggcctcagatttcattagcagtaggtagagtttgtagttattgaaagtctttctcttatttcagtttgaaatgttcccaggttggcacatagctttgggaactggaagtgtctcttttcccttgcttaggtagcctcaatagattgaaagaaaatggacatctcttcttcagaaaacctgttctaagaattatccatcttaggaaattagggtggttattgctcttctttactgcctgcctgaaaaaaatttcccagccctcatttctttcatcctttcctttgaggccatgacttgtcaccctctgctgtgttcctctgtcccctgagcagctgtaaggggtgagagtcacctaccctcaccccttacactcccaccaacctgaggaccacgtgtcttcatctaacagca

SEQ ID NO: 874 - DNA, 1593 bp, Homo sapiens
agcatttctttcttttcctgtttgaagaaactgagtcctgtctactcccacccagcatttgcctggcatatcttcacagttggtctccttatcaaccaactgactcccatgattaggtcagattagatcccctgttcaggggatttatgtggggaactacacactgattgggacaggattttgtcaatgtactcaaatgacaaaggacttcagagatgttggaatattcttggtctacccaaaggttgcagaccacggtggcatttccttcttatataggtcctggtgggcatgggcttgagaagctgaaagaagacgcatggaactcagaatctgatcttttgatgatgacttcatatatatggtctgtttacccacgaggcacacaaaccttaccttatgcctgtgaaatataaaggcagatttttgtcccatgaaggtttctccatagactacattaagcaggagacagatgggtttagcttggctaatcttagtgcaagctggaaaatttcagtttttctgaaacaacatatttctaagaaattgtctggtctagaatgttattctagtgtatgttagggatctgtatgactgtaaagcaaggctgaattactgcaggcctataaatatgtgtgaaaatttacctacttctccctaccaacatggaggtggaaagaagtaggtttaataaaccccatttttattacgtgtgtaaatcagtggctgtttggccatttttctcctatgtaggacttgaatttatatgagaaaacttgagtgtatgccttttcccaagtcttggcttgcatctgaatgtaaaaatcagatgcatgctcaatgaatgttaattcagattatagatagctataaactatataggctgctctgtggtctttcctttccctctgcctgcatgactgaagaccaaactgtcacttccttataatctagttcttcccatgatacctcatcacaaaggtatatatcagttggtcaataacaggacttgtgcagtgaatacttacatgaagcagacactgaagtgcccagcaagaactgcaaaggctggcagtattaggagattgctcaccgtaccccaaatgagatgccagaggcataaagtccattttgtttaggtaccagatgactctgtggaattaacttgatttgtccccagtaatccatattctttagcatacacttccaggcaacacttattgcttagcaacacttacttagtaacctttcagaatgatcattaactaatagggagacagcctgtggtgccgatcgtaggctgttgaggctatctctacgggcattttcacctatcctgcctacttccgtaacctatgccccacaaaacatacactctccagacatgaaatttaaaaataatgaaagatgatgcaggaacttcagacactagatgcaatagacagcaaaaggaagcacctatgttagccttggttctcaacataccaagatgctcttatgaacacttctaacaaaatgttcccaaggagaacacaaagcaggcacctaacatccaagaagcatgtcatcacctcagcatgcctgccacacgtc

SEQ ID NO: 875 - DNA, 23 bp, Homo sapiens
cagtcatattgttcctcatttgc

SEQ ID NO: 876 - DNA, 143 bp, Homo sapiens
tgcttggccttcctcatttgtttaacagatatagtaatgcagccacttgattaggaggcacagtgaccgctcttgagggatcaacagtgtaaccagggaaacatctctttggtcagtcccgtttcactagcctgttcaagaac

SEQ ID NO: 877 - DNA, 266 bp, Homo sapiens
gtgaatcttgctctctcctcctctttccccatgttcagttggcaacaattcatgttgcccccatctcattaataactcttgaatccacctagtcctctgctgttgatgtaggtgagctcttaccattcctggttcccctgtaagccaagctctgcctggttgccacaacaatctttctgaaacgagtcatctgatcaagtgagtcctttgctctaattgcatcgatagttccccgttctcttgaggatagaacctgaacatctaag

SEQ ID NO: 878 - DNA, 405 bp, Homo sapiens
gtcttaatcaacaaagacatagtttatcattttctgtgtaaggcagtggcatggcctttgcctggaaagatttgcaatctcgttgattaaaaattatagagttacttaatctgataaaaaaattatcagtatagacattgtgagagaagttaggaggaattgtcgccaacattggtatagtcaggagtcggagggcttgaattagaccttgatatggatgttaggacaaatagaagtggcgaagacgcaaagcaagattgtctagaaacaaagcagaccattggcttaagcagagagcatgagataggaacaatatgcctccctgtggaggtctctccccagtagacaaagatttcagaccaggaggcaatgggaagccattggcttcctttgatcatggtggcg

SEQ ID NO: 879 - DNA, 68 bp, Homo sapiens
ttcctcatgactgcacctgtcttgtgacagggatctgaaacacaaaggaaagcctccactgcactcca

SEQ ID NO: 880 - DNA, 948 bp, Homo sapiens
atctcaaggttcccataactgatggggtctttggattccaatccttgtctcattttcccaacctgcctgggaagtgggtggttaaagtttaaagcctggaagaatgggggaaatagttcacaggcatgaggtgacctgcaggagaggctgatggtctataggagattggaggatgagtttggcttaaacatgttgatttagaaatgacagagggattggaggcaatgaccagcagtccacagatcagtttaggactctgtgaacgttagtggaagagattacagagaacactggctaggagccaaggcaagaaggctttggaaaggcatgtttgcctttgagtgcttaacttagagactcatgcgggaaagaatctgtggatctctttgagaagctgcagaacagcagatacacctgaatcctattcatgttcatccagaaacgcagactttaaaacaaccttgttattcttcctttgttttgtttcgtttggttttagggggttggaggggagggaagggtgtcaccgggggagcatatgggtcatttgtttgcagttcacaggggttcttagtgaacatcagcgaatattgtcgctgatttcgtctcctgcttcactctcttttctaaaaacaaaatatttaatgtagcccaaaggagaatagtcagtttaataactagccatggcagctctttgaaaactgcaggtttcaaataactaggcctgcacattttcaccaactcagacaattaaaaagactccagggacctaggtggtgctgattcaagtggcgcatattgtcatttaaaatggaaagtctatttctgaaaatagactccaggtatgggagaacttgtttctctgctggagaaggtagcccatcctagggggaccgaggtaaattgcttagtggctcaacatctacatagttaaaatgggcccatttg

SEQ ID NO: 881 - DNA, 489 bp, Homo sapiens
gctatagataggcagcatgtcattggactaggtccgccagatgcagaatgttgacaaaagcagaagtcccctcccctcagactcctctggggaaagctggcagccttgaccaccatcaccgctctgcacaccatagcagggatatgagaaggggctgaggtgagcattggactggaggctcctccagctgtctcttgttgcctgtcctctagtgtgtagagttgcagtgtggcttgaaatggtcatcacacccaccatcaccatggcagccctgggaggagggactggctgctactctctcaagaagggataactgttgcacaaaacactgcagactttgagctggccagcagttgaccagctgacctaacctcccgttttccaggtcttaacctaccatccattccctgcaagtacagaggaaactagaaagctacccttctcccaccatagttctgtaactttgggatggagtgagaagcatggcat

SEQ ID NO: 882 - DNA, 862 bp, Homo sapiens
atatgagtgtgggaaaggggaagccattgcctcttgtttcccattcgtgaccatccctacccacttcagtgggcccagtgttgccagacctgaaatatacctcatgtgggtgtttgtctctggtactctgggttcatttctggtcaccctatgatatttccttgccctaaggtactggcacagctatcgggtaggaggaggccaaggtagaaggcacagagccattcttgcctcaccttctgccacacggtgaccccacatgtctggggagaggctcccggcccagggaggaggaggtggaaggtgcactgtcataaccatcacagggggcaatggcgagaaggctcatgggccacgtgcctcggccattagttgtcatgtctgttgtaccccaacttaactgacttctaaccggctgtggttatgagttccgctggtctcacctttcagtgggttcaagggggcagattttgctgacaccataggcaaggaagcatgatggtaaacaccactggaatgagaggccttgttaatccagcccaagctcctgccaagttagaagctgaggagtctagtctgggccactttgagtactgatgcatgatcccagggcgatgtgctgttctgggcacagggtcacactgggtgacatctaacaggctttgcttgggctgtagctagagggaaatgggagctggggagtgtgacaggagggaagtgtggactctccacctaccaaggggccttcccacatactgtccatcccattcagcgccctgaggtgggcgtcatttctcccacttgacagataagggaatcagaccatgaggcagagtaactggccccaggccacacacaacta

SEQ ID NO: 883 - DNA, 606 bp, Homo sapiens
acaccttctgatgaactgagctacctcgtgcaggacaggcccaaggaaaggggctcaggccagagtgggagcattgaaacagggttcaaaatgtctgtctgcccaaaccaaacgttaatttgcatactaatagtttaagggcatagatataatacagacctcccccaagaagtgacctttgaagccaacttcttcttcatgtgacggaatacatcagacaccctgtctgccgggaatccttacccttctcctagtgagccgtggtctctggcctatccagaagctccttaaaaatactagtgcatgagatgtagcattgacaggagccctggcctgtgggtcaacagttgctttgtcaaatgcaatcttgcccttggcacagctcgccattcaggaggatggaggaagtggacgagagagagggaggtaaaagaagggagggaaaggaagcaggatgcctggctgcctggagcttccttgggctcttgtccatgagaggaagccatacctacctctctggggtttgccaactcttgtccaggaacctattgggctagagtggaggggaactgcagagtctccccttcctttctcttctgcccccat

SEQ ID NO: 884 - DNA, 141 bp, Homo sapiens
gctgatggttctgtggagtgttgtgcacaaggctccagcccaggtcctgatgcaggactctcattctggaaggctgggtgcctggctctccttggggcacaattaggcttcctggctgcattcctggggcattcgcatgaa

SEQ ID NO: 885 - DNA, 43 bp, Homo sapiens
ctctgaagaaccttactatcagtattactgatattaccagaga

SEQ ID NO: 886 - DNA, 309 bp, Homo sapiens
ttgctgatattgattattcagtaggccagggaagcccgtctaccagcctacaggacgtcattgcattcaccttctcagtaaatggcaacagactcttttcctaatgtttacacgtaatggattgaactggcttagcatcatgctttacccatatttctgttgacagcctgttactgtgtggagagaattgctggataagagccactgagatcaaagggatctttacaatgggcctttcagtatatttgttctgtaatcatggactgaaaacttactgagcacttgccatctgaatgaggcaaaaaggaa

SEQ ID NO: 887 - DNA, 175 bp, Homo sapiens
tatgtgtatgcatgatttgtttttgccttaaaattagtacatcaaccgtgtaatgtgcaggacatttaaaatatgtcagagctatgacaggttcccagctactgggatccaggacaccttccaatttcatctttggctaagactttctatctcttttttcttcttctttctttct

SEQ ID NO: 888 - DNA, 179 bp, Homo sapiens
gcccaatacacttctgacctcagggcatagatgcattgaagggcatctgctgctgtggccttttggatgggaaccctgtagatctcagctaggttggtttatcagctataatgtattccttgatttggtaaaacagccagcagcagagcaacatgcttttacctcctcttttttttttt

SEQ ID NO: 889 - DNA, 85 bp, Homo sapiens
gaatctgaaaagaaaaatcttttctgagtagatagtattttaggtgtgaaaaggaatattaaaacgcagcaatgtggcaatctgg

SEQ ID NO: 890 - DNA, 579 bp, Homo sapiens
tacttaagataagtgaaacacagtatttaagaaataacatctccagaaacttaatggtacatatacaatagggtgtctaaaccacgtaaaattatgattatggcccctccgtctttctctctctcatatcatggtatgttctgattaatacatatctcctttatcactttttttttagcttcaaatattcctcctctaaaaagttcttgccctcactaggaccagctacctcatgtctttgtgattacagattgttttaaaatttatctggcctaatattcggttagtacattctaatttagtctatgggtgttatagttcatcacttgagacagagcataattgggtagcaataactcagacactcaccccaatctaaagggttctaaagaagaaaaatccccatagtctaaatattaaaacctaagacacacactataccaggagtaatcgaattcttctgtattagaagttccagaccttagcaaatatccctaatgcaaatattgcagagtaaaatgactgtcaaagttactgatgaggcatttccgatcatagctttagctctgaatatgttag

SEQ ID NO: 891 - DNA, 19 bp, Homo sapiens
tataaacatgaaagtgcct

SEQ ID NO: 892 - DNA, 934 bp, Homo sapiens
tcagtttgctatcccaagcacaaagaacaatttaagcttacaaaattgattaatatacaccctgaataaatttatgtcaagttccttcctgtaatataatcttgtttttctacaactgaaaaatgagtcttgaaggaaagtaaactaaaagctgaaaaagcacaatttctatttttactttgaggtataaattgcctttgtcattttaaaatatgccaagttaaatattatgataaatgcataggcttttcagacacatattttaaaacatatttaagtatgtaagttttcccaacatgttaagtagaaccaaatagcagccaaattccaagtacacgattacagctgaatgtagaaagctgtgaagaatttagtaacgtatagaaaacccggtcctcagtttagccaaatactctaatttggaagtgctaaatctgatgtaattccaaacctttgctaaaagagaccaagacatgacatgagacaaagctatctttggtcttctacagtttatgcaaagtcaaaaattttttctatctgcaaatttaatttccatagcttgataaactcatgtctacctaatacgtattttcatcaagatagttactttgatttaaggtaatatattttaccctaggtttatttattattaagcatttaaaattgtgttttaaaaatctgtggcactagtttcactagaattttattgattctgttattctattagtcaagatgcaggtatttgagtgattgcctcaatcttatctctactattcgccctttattttatcatgaaattttgcagcaaaatggattgtctgcaacaccaatactatggcagaaatataaaattcataaaccctcttaaattaggaaaagaaaaggaaaagaggaaggaagaggggaagaaaaaaaggagaacaagaagaggaag

SEQ ID NO: 893 - DNA, 1024 bp, Homo sapiens
taacacataggcatcatggatggcattctgtgtacgatgtatatgaaaggacttgtttctttgtatgtgtgaaaggacttgcttcctagctcatactacaattgcaatggttttttgaggaaaaaactaactaatagattaaacatagagtatagattaaacatagagtgtaaaatagtgagatggaaagataacattatagacatacatataattataggggaaaatgccaaatagataatatagtattttccacctctgaaatatatttatatctctgagatggacacacatgttcagttttatgtaaaggaaacacaggatatttaataacagttttgacttaacaagaaaatgagaatgaatgtcattccccaggtgtcattctggctgcctcagactgttctcggccacccatcagtcctgattttagtgcagataatgttgacataggcgtgtggacaaaccattgtatcacctatgagggatctaacagagtgtaatcgataaagtgtagtctcaagacaattattgtaaatttaagctatgtacaggacaaaaaaggtaaatactatatacaagtgagtgcaacttaaaaataaatgtgtttcaatgagaaaagcacaaatttaaaattgtaggaagaagaaaaaattttgtcaatattaaaattttttcattaacaggaaaagtatcttcacaaataaacattattaatggatgcaatatagaatatacttaaatatttatgccctatttggaatgaaacaatctttaaaaatatttttaacttgatgtctggtattcttttacaccgatttgaccccacatatttagaaattgccatattctatagagaaccaatttttattaataattctatcattaatatctttgctcaaatgttcatttaaatctattattttatcacattatttaaaacatctattatctgatgctgtattaatggatataattataatgaataatattaacagataatatatagatgatactaaaccag

SEQ ID NO: 894 - DNA, 114 bp, Homo sapiens
agattaatattattaatctagataatatttatctggatcctattaatgagaatatataagtaatatcttttatcatatgtaaaataatttcaaaagagtacaatttcagggtaa

SEQ ID NO: 895 - DNA, 1711 bp, Homo sapiens
tcaaccctcttctcgttattggctaaaaatgacatttcccttttatttgaataatgttctgtatttttcccatcataacttctcagaacagcagtgaaaatccatgttactgtgtttgtttcttaaaccatttaaggaattagtttgttttttatttagaaagtcagtttttaccaattctgattataatgatgttttaaaataaatgttttaagaacttaaaacattaaactacattgagctaatataacttcaaaaataacatgctctttgtagaaccagagaccttcagagagcaactcatgctgtttacttgattttggttattgtctataataagtgaagtgatgcctaatcccttcctatttctaaaggaggatataaatataaaagactctttgattaggaggaatcagacaagagattttttaggaaacataaaaatatcagctgatgtacaatcctagcatttattttactgtttcttaatgtgtctctttgtccaatcctcccatggcatcagatcctacagcagaaagtgcttatcaaactgtccaggggccactgcatccctgggcttattacaatgccagtattggcatcgtctgatttccatctctatatttgccatattaacaagttgactgccagagtagtacttaaatgagtttattaaatgcattttatttttgaagcagtattctatagttttagaggtgacccactttgtgtttaaatttcaacacattttttgcaaagattggttttataactcagagaagaatcacaagcactgtggtaacataaaacaggatgattttttttccaagtgtccaacatgagagagtgtttaaatgtactgtaaacagatttgctgaataaacggaattgaaaagcactcccatgggatgacagacagaacagggtgaagaaaatcagcccaataatggaaactgagaagcaaatgtataaaaccagaaaaacattatgagataaaagtcagagcatgtagctctgcggagacatggtggaaagggtcactcctccagctacagcttttttcttaaagcctgtttagtgcactactggtagagccactgtccaggggccactgcatccccaggcttattacaatgccagtatcagcatcatcttatttccatctctgtacttgccatacttaacaagttgactgccacagtagtgcttaaaagagtttattaactgcattttatttttgaagcattattgtatagttttagaggtgaccctctgtttgtttaaatttcaacaattttttttttttttttgcaaagattggttttatcacccagagaagaatcacaagcactctggtaacataaaacaggataatttctgttatctctcatggctgctatttacatggcatttcttttttatttttatctttgaatttaaagttgctgctgcttgtttgttttacggatttggctgcacgagtccagtgcatccccagatgcccctgctccaattacacccctggattcgaaccatttagtgatcagccactgattgggcttaagtcccatgagtcagtaaggtttccacctttaacgttggatctaggcatggcctggacaccaccccacagttcagggggttcgtgactttatgcattattcaggcaggaactggggaatcgcagattctggagatctgactctgtttt

SEQ ID NO: 896 - DNA, 676 bp, Homo sapiens
ttgactttcccttgttacatctcttgattcacttttcctcatttctgggactgtttttgtttgtttggtcatttgactgtttagtaacttggctgtggaatgttttccttgaagtttgtattctctgctatttatgctcagatgtttgcctttattttatcttgcattctggcttcttagacattgctaatgaatcaacataagccatgtatggttcaagttttatgattagtcccccttagctagggagattttcacccttttacattgaatgtacgtgcagcttagagacagcttccacagttcagaaaggttacggttttaaccttcattgagccaagaacagtgacttcagaggtccttctctggtcttttctccaaggtagtagtttggaaacatacactgttttccaaaaaaccaggaattagtgtgattttatgttaaatctagctttccagatggtacacctggctcagagtagcttatggctcagctggtgttttaaaagaagttgtgtgtaagcacctcaatccagtaagcattctagatttttctgatgaagctgtgtaaattgcagaatgaattcaagtctgccctgtttttcatggtgcatggtcccgagaggtatagtacagtgcatgtacacagcctcctggacctcaggaaaaagttggg

SEQ ID NO: 897 - DNA, 215 bp, Homo sapiens
gtgttttttctattagtgtctgtattaaacttacaagtctaccatttcatatgatgcaattcatatggagaattaccaattttctctttattgccagctacgaagatcctccatataaactcctccaggcttagtactacataaagtcagtcccttaaggctatactatgaagctctccatccttatagcccacatttttacccttaggaagaac

SEQ ID NO: 898 - DNA, 30 bp, Homo sapiens
tattttgcccaaatacattttcaatatgtc

SEQ ID NO: 899 - DNA, 261 bp, Homo sapiens
tttctatagctatcatatcatttcagttagaatgatcttgaggtatttgatattattgtaagtggtgtaatttctttagtaacgttttctgtctcttgctgatataaaacatgtataaacttttcaatattaatcttatatcaaacatcatcttaaattgttttattatttaagataaaaaattgaattgtctaatataaacaatcaggtgatccagatttatcttctttaattttattatctatgaaccatagaaaaacc

SEQ ID NO: 900 - DNA, 584 bp, Homo sapiens
agaaaaatcttgagtcaaaatgatactggatatctttgccatatttgtccacttaagggaattttctaatatttttcctatataagatggtaagttaatatttatgcttaaataactttattgagttagcaagtgttgtgttactaatgtatgttgaattttatcaagggattgaaaatttcaattcatcattttaaaaattcaatcttgtaatatggtgaattacatttataaattttcttttattaaattctacttaccctttggggataaacacgaaatgatatagacttagacataaagtttgttaatatttcgcttataaatcttatacccgtatttatcttttaatagttttgttgtgcttatgctggcctcatattaagacttaaattatattcctcattttgtattacttatataatattgggaggactttctatttttaactaaaagaactattcagtaaaaccaactgtgcctagtgtccatttttagaaaaaaatcacccttgttttagttttcagcagtttcataaataagcttttatattttcaaagtttacaaaatttgtgtcatatgat

SEQ ID NO: 901 - DNA, 20 bp, Homo sapiens
tatatactcccataagccta

SEQ ID NO: 902 - DNA, 34 bp, Homo sapiens
ccctatgtttgttcaactatttaaatagaatata

SEQ ID NO: 903 - DNA, 475 bp, Homo sapiens
tgaggccaagcaaatctgtgctattagtgatctgctttatttttgtgaatgtaaagagtggtaattgggtatgcagaatgtgaccttttattgtcttaggaaagttctacttattcactaggttaagattacacagtttcaatcattttacaataatcattgtaaaaacaaacaaatctccaaataattaaattgcaatgtggaagacagccttgaaataatcacaagtattcaaatcacaggccttaaaaaatgaaggaatatgacataaaagacgtaagcataaaatctgctataagaaaaatggtgtccctaaagaaaatacttgaactgaacaggcaagaatctgagggatgatatgaaacaacaacaacaaaaacaaaaccatgggcctagacaatattgaaaaagaatgcagtgatgtctttacattcaagatttaagaaaatttccaataactattcatatagttatg

SEQ ID NO: 904 - DNA, 260 bp, Homo sapiens
gtggaagaaaataaaaaatggcatcagatatttctattttgacaatattaaaatatattgagagtatacagagattaaaatgaagaagttggggtacaaaatatcaatagtaatttatgttgtaacatacatgtgatatgtacattgttagatatgtgaaacttgggaatgtaccccaactatttcctcatgctgaggaaaaaatgcacacaaatagaaaaaagaacgcttgaatatttactcttgctctataaaggttc

SEQ ID NO: 905 - DNA, 218 bp, Homo sapiens
ccagtgtattatcactaattttgagcaatggaaactaaatgtctaatgaaattaatttgggtacacaaattacagcacatctgcaagataacaaagcttgtatcaatttaaaatgcttatgaaataataatatgcacggtatatcaggtataaagtatacttcaaaacagtactgtggtttaattccaatttaaaagaggaaaaaaataaatgtctgg

SEQ ID NO: 906 - DNA, 148 bp, Homo sapiens
cacatggtctttaatggatagatactatttttgttaaatgtagaaataaatatctatttaaaagaaaatattcaaaattgtaaatcaactatactgtaatacattagactgaagaaacttccagaaaagaagctaaacaaaacgcctc

SEQ ID NO: 907 - DNA, 735 bp, Homo sapiens
cgtactttgtaagatgaagatgttttcagatttacatattttaatttcctgagtgctgcaatccatcaacttacttgccaaaatatacagatgtccttacattgcagtagattactttacattttattttctccaatttgtatggagtcacaaatcaaaaagtttgcaacacagttttgattaattaagactcaatagaagctgtttcctgttttaggtttgacagtaatttagcgtaatataagtggcatggcattaaactacattcctgaacagaattcacttccattaacaagctccattagagaaacatagctgtctacaaatcaaccattttgtgtcagtttcagtaattacggtttggggataattggtgtaatatcacaccttttcttatagtgcttgaattgtttggctatgcaaggcaaggcatactgttgaataaagtataagctaaatggaattttaaattatttgtatcagagactgctactctgagaagaaaaaagccaattgctttatgaaattcatgactgctattttaactctgaatgaataatatatttattaacagacaatttaaggtaaatttaaaaaatgcatataaatattaacaaaaatttacctttcttaagacatggtgatttgcaatgtcatactccattaagaaaaacaaatgttgtacttgtgttatctattataagggtatatttttactccactaaattaaaaaac

SEQ ID NO: 908 - DNA, 600 bp, Homo sapiens
gcagaaatggactgtgtacctgcttctaaaagtgtgtctaagtttaatactgggattaacacatactaacattgtggaaaatctgcatcacagagagcagttatatgttgtttgctctatcatttaataaataagattcttcagtgcatataaagtgctcttcctaagcaatttcctctcataattcagctgtgtgtttgccttattgctaaactaattataccaaacagaattgtgattactaataaaactactggaagcttgtgatttatgattaaatgtaaaaatattattacctcatttctaaaaagtgtaatttttgactatcaatgcgctgtcaaatttctaattcatattctttccattgtaaataaaaccggccattgtatcagacatactagatgactctatttgagcttgaaatggagatatagtatagtaaatagctttggccagattattatcctgagttagttgtcatttacatattaaaaaaaaattatgtcacaatttaaaattataatgtatcccttttttcctttcatgtctagctattggagtagctataatcgcattcttgccaaaataattatgaatagg

SEQ ID NO: 909 - DNA, 166 bp, Homo sapiens
gtcatttaaaaaaatacttagtccttgtatcagcaattgactgtgtaaaattgaattaatactattatgctaaatgttaaatatcatcaaataaagctgccatcaataagagacataattttgtgtgcaaagcaagagcaaaataatgccaccaattaaaacatga

SEQ ID NO: 910 - DNA, 38 bp, Homo sapiens
gaagatatttatcatttcaaaaatggctgcaaaacaat

SEQ ID NO: 911 - DNA, 53 bp, Homo sapiens
agtatagagatccagtcattcttttcctttttcttttttttgattaatgaaat

SEQ ID NO: 912 - DNA, 103 bp, Homo sapiens
taagctgagccactggtgcctatcaatgtatatctaaagaaggtattgatctttgaaagagaggcaatagatttgctccaaaaccctagtgaaatttaaaggg

SEQ ID NO: 913 - DNA, 49 bp, Homo sapiens
tttatctttttgggaaaataaccagaaatgtaattcttcaatgttataa

SEQ ID NO: 914 - DNA, 22 bp, Homo sapiens
acatttcttatgataaaaaatc

SEQ ID NO: 915 - DNA, 199 bp, Homo sapiens
ttttaaaaattctattatgtctacatttttgaatcattcatacttaagcctttttactggttagcctaggattcacaatatcatttgaattaaacttgtgttatcttcaagtattattatttcatttgacatataggaaactttgaagagtttgttcctgagatctaaattggatggtttattcttttgttttcacata

SEQ ID NO: 916 - DNA, 400 bp, Homo sapiens
gcttcacgttcctctgatgagaatttacatatagggctatgtctccctgactttagaaactattatcagtccacagaggcttggatatcacttgtcatccatcctacatctgaccccaaaacccctccttaatctgcttgagccctggcatcccataatgaagcatgctcctttgactgatcccagtgatccgtttcatgttatgatgtcttatgccacactcttgcatgtgtgctctgtaccctgtagggttcagggtctgatgcttaacactaggcagctcacctgtgcatattgtcttctcattctcattggttccccacaccacaagccaaattatgtcttctaaacagatgccctcctcaccttgctttaggtgagtaatagctctctctctctt

SEQ ID NO: 917 - DNA, 64 bp, Homo sapiens
tcagcaaaatggaaacctgtttcaacatctgcttttttaatgcactctcattttcagggagtgg

SEQ ID NO: 918 - DNA, 144 bp, Homo sapiens
ctggttgattattcagtagactagacacagctgatgaaaaagtaagcacggggtcacattaacagtagaggaagcaaacaaatatgaaattaaagcaaacaattgctaagaactacaaatcgttccttggttatctataatggg

SEQ ID NO: 919 - DNA, 1443 bp, Homo sapiens
attcctgaagatagcatggatttcttgaggaccaatttaaatctaaggaaacctagcaaaaattaaatagatcaaattagtgtttgtaaccagaaaaagctgtggctgagaaaactgataaataatttcaggggcagcaatttttactctcatgtgtagctttaggagatgacataagtaaactcggaaacaggcaacttcctaaggactggggaaaatggttaggatcctgaactgtctaagaatatattcagtgataggtgagatttagtcagaaaatagaaacaagggtagggcctataatgaggtgggaactaaatccatatatgacccaataattaaattagccttcagagcttgttatacggtattaacccttgactcctttttaactagaaaataaatccctcatataatgatattgatgttcagtgctctaattatagaaatagtgtttggaagttggaagcaagattatgtttggattacagcctttaggtaaaaggctaattacctttacttaattaattaattccatcagtcatgcaatcaataaatcagttatctacttactatatatttattgaatctcccttacttgtctggtgctgggctttccttttgattattagggtagggaaagatttctacctctaatcctaaggggaaatgaagcctataaacataaattttctattttaaactttgtaacaatacagccatgtactttgctgaaagctaattttgcataacagtgacacaaaagtggattttagtacacatgccatttatcaacctataaacaatgcctttaacataaaacaaaagccctttatttggatgcacacattgccaaaaatcttatagactattataagatttatgatagctttcacatcattcttttttctggcatccacttgagtgcattaactttgaaaagaaactatttggcttgaattgtgaatatgacttcaaacaataaaagcagaggaatctatagagcagctgctttcttgtatatcaatacacaagtgtatatagttttatatatagaaccatatccctgtgcttttaggtagctgcaagttcactttacattcatctgaaacacaagaagggctgtgtggcaaatttaggtgttagaaaattgttaagaatttgttgacacagtgacaaaaaaacacaatgaactcactattatgtgtttattacactgataaatgtgaattctatatctgataaaatgatttttcagaactcaaatttaattacaaagcaaaagctgggaagcttggtatatgattttcaaggagacaatacagatattctaaaaataattaaaacattattgtggtttcatcagaaagaaatatttgtgaaacagagctagactctctgaaatatagttcaggttttgtgataacatttcatcagacatgt

SEQ ID NO: 920 - DNA, 276 bp, Homo sapiens
ttgtcatttaaactctttggtccaaatgtgagtatcgaacactggaaaatcatctgacttcatttgactattccatagtgtttttctgtcattcattcaattaatatatgagaaggagaaaagaaaaataggcttttttgttcactacttgcaataaatagttctgttagaacctggtgttgaattccaaaataatgatgagatttacaaaaaaattatctggcctgattatctttcaatatcacagtgactgattatgacactaaaatatcagca

SEQ ID NO: 921 - DNA, 328 bp, Homo sapiens
atggggttaaacaccatgaaatatagtaactcctaaattagaatatgaagataatggcacttgagtggattagaagaaaagcaagtttttcatcttgtacaaacagagccttaaattttattgacagtgtgttaaatggagagcattaactagaaaatttggatgattacttaaaaaattgcatagtccctgttttgacagtaaaaatatgtagttaatatttttgtaaaatgaagttgcttaattaagattaatttaacaaaatatgttccatattaatttttgttaagagtcacctttgcacctgatataaaacagcattatcttg

SEQ ID NO: 922 - DNA, 1008 bp, Homo sapiens
aaaattaactaaaataaactatgcttaaacaatgttccaacctttaagatgaagttaatcatactttgttttacttgtttataagcttaagaacatattattttcgaagatataattcactgagatataaacatgcattatatatatttttttctagatgataacttactcaatgacactaaattaatgtttgctgagaaatttccatcttattttgagtttttctatcaaacatattttactgtattacatctagtaacttagtaaataagctatgattaaagtagaattttgataatgctatgaaatcatatatgaattttgtacaaaaattaaattctgtgattttaagactaaattctatgaagaagggaagtctagaaactgactttttataacccaaaccttaattatctgattcaattaaatcatattgaaattgtgtgttttaaataacaatggattattagcgtgagaaaaactattttggggaaaaagatgttcttaattaccattaaacaggaattaatctgtactactataaatgtataaatatggtgctacggccttctgaacttgatgttgttatactatagggagaaagctatttttacatgtactggtggaattacaaaaacctgaagtcaataataaagtccatctgtatgtcacatccactgcacggctggcagcatggttttctccattgtgcgaattgcaaaaatcaaatttattgaggagatatagaaagcttaacatattttatgaacaatataaagtgtgactcactcctgtaagtctaaaatcaatagctaaatgtctaagaataaaaaaaggcccttaatttcaataaatacaacacatttttctactacgctgtttctactaaaatatcccttcttgagggattaaatctcatccctgctgactcccattgagtaataattaatgtggttcatttttgaatagaaagattgtgatgtttttaaaattaaaaacactgatcaa

SEQ ID NO: 923 - DNA, 266 bp, Homo sapiens
tgcctcactatgcctgttttcctctccatattaattgtgcatgaaagaagatacagttaattaaactgatagagatacattatatatttccaaaatgataataagtatcaatctcatcaagctgaaatctttaagaattttagtaatattagcaacattttaatttataaatttacatatatggaaaaagatataacaatattaggtatgaattactgttgtgatgtgaaaaaaacaaaaaagatatatgtttttaaattaaatat

SEQ ID NO: 924 - DNA, 1832 bp, Homo sapiens
cactggccttcccaagtccaatgtctaatggagaaaacttataaaactatagatgaaattattttcctgtatcagttttatgttaatacatcttgtatcctctatgccttctttctattaacctctcctcttgctttttctctctgtgatattttgatttaggataacaaacctagtctgaacaattttcttagccctaggaaattggttctcaaaatacagctttattaaatggtaattaaaggctttaaaataaaatttcaaatacactggcttgataatagattgcataatgttcatttgttatatccaccagagaccttcttgaaatttataatttgtaggtcattttattatattttttctggtgtgtagtgccatgataattgattatatatgtcagtaatccatgacggaaattgctttcttacctatttcaatagtggagctacagtaaagacaaaaataactatctgttatagaatcaaaatgggattataaacataatgatgaaaatatctgttttaactattagcagctttttctcagtgcatgattgctaagaaatcttattaaatatcatgaccacaactgcgttacttggaaaaccaataaattgacgcatgttggagggggtcagtgacttttatacaaaacttcaaaggctgccatgttgcttcagaatgaagcactgagggatggtagtagttttattttaatgtttcttaatttgaataaccataatcttgagttatgtttgtgcaatatagatgaggtggagtttgcaattatagaaggaaaagagaaaagagagaacagagggaaaagggaaaataaatgaaattttaaacatgatcatatttaaaacaaacataattgctattagagcaatgagaatcttgggaaaaaggctcataaaattactaactatcttgagtcactcttgcctgtgctgattgaaagttaggtagaagaggaacattttatcaggaagaagacatttgtacacaaaagggctgatgatttagtgtgaaagaggcacagagaaagtaacctataatgggcatttatttgggtaagcaggtgtgaaaaatactctagggagctgagtgccagtgtttagaaacagctcaggctctgagcacttgtaattatgcaggctttccctttgggcttacttgtttatctgtctgttggtggttggctgaactttttaaattaaaattttgatgaaaagaaagttcctgccttaaaaccatactttgtaagcctaaaaaggactctagagagcaactttaaagttttatgaggatatttttaaatatcagttttatttttattgtacattttacttttctatttgcactgctctgcttaggaggaaattaatttagaaaataaaagaaagtggcccccaaagtcttccaaattgtttttactgtactttgtaaaaattaaatctggttagcttaactgtggcgaagatttagtttaagggctggaaggatgcattatttttttctctttttaaaaaccttaattatatttattaagaaaaattgtttcagtataaaggttttgtgtgctaaagtctgactaaaacaaaaaaaaatatatttttctttgactttctacaattcaaatatgtaaaaacaataaaaataagtggaaaataaaaatatacttacataaaatcatgaaaagataaaaatgggcatatgattgcacaaaagccttgctaatctgacattttcattctcaatcttgtctgacatcacgctggctgcaaatacccaaatatttccaaatatctacttactgttttttatatc

SEQ ID NO: 925 - DNA, 297 bp, Homo sapiens
aatatacattttaaaatggattactgaatagatagttgtaatttggccatcagaatgacagagacaactatatattttattttaccatctagaagcaaatgaaagaagaaatattccataaatactttatgcttttgaactacatggactcaataaattgacagaaatatgttattaagattacaggataatataaaaatggaggttactgacataaaaagtaaaatgagttcaacaaaaccatatttcactaataattaaataaataggataatgtgagaagacaagaaagactgc

SEQ ID NO: 926 - DNA, 138 bp, Homo sapiens
agtaacggggaacagtgatgaccatgacaacacacgactcagatttgttgccacacagcacaatttagagacagcaccagattctctgctcatcaccatgttaacaacagattcattcgtgagcatcagattcatgct

SEQ ID NO: 927 - DNA, 77 bp, Homo sapiens
gtgaacacattgcattggtttagtcaaaaccccattagaactgtgctgctgcagttctagaccttcaaacccaacat

SEQ ID NO: 928 - DNA, 98 bp, Homo sapiens
ggcgacaggccgagtctggattcgggattagagaaggcgatgtccactttacttttcctgactttaatcgttatactgggccgggcgtggtggctcac

SEQ ID NO: 929 - DNA, 450 bp, Homo sapiens
ggatgtaccccccacaggagggaggcacggcccccccaaatccctccaggaggaagacatgccccccaaatccctccaggagggagacatactccttatatccccccaagagggagacacgcccccagatccccccaggagggccacaccccagtccccccataccctctgggtctctgggacatcggattcgacccccaaccccctctggcagagcccccacccctgcacccaggtggcactcacgtcttacacttggcacattcttccacaaacatgttcccgtggagctctgccagtttgtccctgtgggaagagcaggaagaggcttgatggtgggaaaggatccctggatgcccaggctttggagctggtgctaagcccctctcctccaggaaggcttcccggactcctctcccacaacattgatcaactccttctttctggctc

SEQ ID NO: 930 - DNA, 198 bp, Homo sapiens
gaatcattaacccccaaggctgaacccaccttagataacgggaagccctttccactcacaaaatgcccgtccccctccgagagcatatgggaacctcttgatgtcaccaggtcagaagcacaggaattcaaattcccagtttataatggaagaaaccgagacattgaatggccctgaagcatgagatccaatcccagc

SEQ ID NO: 931 - DNA, 452 bp, Homo sapiens
ctgcaacttctagaccctgacagctctcctccccttagccccatctcgagggaaattctgcctctggcctcagccgggacagctctgagccatgggactcagagatctccacacactgggccaagaactcagggctagaatcttatagaaccaggaaaaggggactctccccctaaaaatgcaaacacggtttgtggggccccaagctcttttgtgggggcggggccagggtgttacctggggaagcctgagcgcacatggagcccgtccacgttctggctgaccaggaagcggaggaggcccacgcgctccagctgcaccagcgccatgtgggtctgcgtgggccgcgcgctctcaaaggtggtgtcgaacttgggggccagacctcgctcctccatggtccagactccgtggggacccctgaaggtggcaggccgggagagatggacggg

SEQ ID NO: 932 - DNA, 137 bp, Homo sapiens
agagagacagggagacagagagagggaatcagaaacagaaatagagggtgagttgcaagaacagggagagggggatagaacaagacacagacagagagataaagagttaaagacaaagcaagtcagagacagaattg

SEQ ID NO: 933 - DNA, 24 bp, Homo sapiens
tgaattcacacgaaggcaaaaatg

SEQ ID NO: 934 - DNA, 25 bp, Homo sapiens
aaggaggagaaattcacgccttggc

SEQ ID NO: 935 - DNA, 30 bp, Homo sapiens
agtggaatgctggttgtgacaagggacaca

SEQ ID NO: 936 - DNA, 416 bp, Homo sapiens
atgcccagccaagggacacatcttaaagggagtacccaggacacatccaggaggaaagcagatggatgtgttctcattcccagatgtgtgtggctcgcagggaagcctctggcagcctggtaggccttgcctcgacttcccctgcacaatcacagacctgaagtcggggatgccagaggcagtgctgatgccggcacccgtgtggaacaccacactggaagactgccagaccagcctcgccagttcccacaccttccgctccagctcctccggggggtcgaagatctgtggggggagagagcagacggaggggtcaaaacagttcccccaagtggcaaggccacgcacgagccacagactgagctgtccctgtcttgcctgagggaggaaaatggattggaaaaggcagcttgtcc

SEQ ID NO: 937 - DNA, 31 bp, Homo sapiens
ccatgcaacccctagtcagtctcccttacta

SEQ ID NO: 938 - DNA, 52 bp, Homo sapiens
gtgactaacagcagcagtgaagagtggggcttctggacgggcgcacaccatc

SEQ ID NO: 939 - DNA, 23 bp, Homo sapiens
ccgatccctccacttcccctctg

SEQ ID NO: 940 - DNA, 780 bp, Homo sapiens
gttctccaggtgtgtttattcccacctccctttgcgcctgtcgtcccctcttcctggaactacatcccctctctccccgatcagccccgacagggtgaccacagagttgggcgtgttggcgtcccccggcgcgcaggggcgtcacttcccgccccttcctcactgggaagtccctcccattgtctagcctcagtgccccctgatattcccacaatgcccccctgccatccggccgctcccagcccgcggccctggggcgcgatgctcgggaccctcagacgcgctcacctccgggaggccgcacttgcccttgtccgcgtacggcgacagccccgccgcgtaattcaccgacatcctcgactgccccacgggaacaataaagtttcccttgttgaggccgcttccgccggaagcggggcggggcggggaagaaggaggaaccgcgttccagtcctgcgcacccggcctcccacggcaaggcgcatgcgcctcttgctgacgccgcaggcgacatgttatctgctgtcagaaggaagcctgcctctttgcatgcaggtgtttgcggggcttgggaaggggctccccgatgacccgggcgggaaattggggcggccgcctacgtgagagttctccagtcacctctaaaatgcgggacacaggctatccatgtccccacaaccccttttacggattagtaaattccgtaaggacagagccggacagcagggaccccagcctaagggttttgaatgccacgcagagttacctgaatatctcatt

SEQ ID NO: 941 - DNA, 86 bp, Homo sapiens
aagttatctgagtatcatccaactggaggttctgcattctgcaggacaggtcctgctcaaggtcaatggggctggtggcctggagg

SEQ ID NO: 942 - DNA, 633 bp, Homo sapiens
tcttcccgccagagccagttggccaacaggcagtccgctgccagcctgtctcctccctcggctcatccccggccccctggggcggccgcctgctcagagccgatcaggtgtcagagtggagcggctggagctgctcgtggcccagctgggagtgggtaaccggagccggcagtgggcactgtggccgggagctcggggcactggagctgcaggaggtaggggaggaaggaggtgggagaggcccaggacggaggatccccttatggccccaggcccctgagcccttgtatgtgggagaaagaagccgtgctgagtcctagccaggctgcggagctacccaggtaccctgacacacacatgcactcgttcacccacgcacttcccacttgccggcctgtgccctgcctagcttcctccaaggcaggtgctcaacatcccacccggccatcaggcccttcttatttaccatcacctcttccagcaagcagcttcctaaatttagcaggcgtttctccctcccccaagcccacggattgtcttctcccaagcagcctgtgaactcctctgttgggtgtcttattaccccctgctttgggtgtgattgaatcctccagtcagaggtagaagaaaaaa

SEQ ID NO: 943 - DNA, 508 bp, Homo sapiens
atctgattaaagggtgatgaagaaccatgagaacatgaattgggtgggtgggtttgtgggtggtggccagtgggtggttatacagtgcttaggtgggaggatggatgtccaggtgagtgcataggtggtaaatgcgtggaagggtggcttggagaattcacgagtagataggtggacaggtagaggccatgccaacccctactccttggtaagaggcaaatacagattctccatcacagaaatccctttcacacatagggcctcacagtcacacccctcaaaaaacacaccccctcaagataggcctgcctgacctccgtgcctgcccatgcggaacgtagaacaggcccaggtggacagaagtgcacgtgtgcacacgccccacactcaacgtcacacacatgcatgcagccattgccccagacctccacccactatgggtgaattgctgtcacatggaggttccctctgactatgtagcaaacatgcctctgtgctgagagccgtc

SEQ ID NO: 944 - DNA, 579 bp, Homo sapiens
aggtctgtgtcttgctctaggggccaggactggtcaggaaggaggaagcggtccttttgaggagggcgaggcaacggaccctgccgcccaccaggactggtgtccctcaccttacccccacccttgccctcctcaggtggcctgtggagaggagaaacacagggcaccaactatgaagactctcagggcgcgatttaagaagacagaggtgagtgtgaggccctagatgcccgatacacccctgcaacttcagccttctgtctcctggggcttggctgaagatccaccctttcattccagtacccacctcttctcctttcctctctgctgccccctagcgtcatgacctccccactgctccccgtacaagctttccagcccaggcctttacccaggccctagtccgctctccatggaattccttctcgccgcattgccaccaatcagaccctcctaattcctcacaatttggccccagtaccacctccccgtccaatctccgctctccccggccacagtaaccccttgcttttccaaggacccactttcccgaggatcctgatcttttgctttggtgtg

SEQ ID NO: 945 - DNA, 260 bp, Homo sapiens
atccagctgtcttctcttgcatccgtgtctttggctatgaactcctagaaagacatgcttcttcctccattgtccccattcttctcagccccctcaagtccctgtggcggccaattcagggcacagatggggaggatgaaagggagggctcacctccagggacaggcaatcagccttcctgagcacctctttgtgcctggcctgggtgggcaagcttgacttggagcctttagttttcgtatcatgggatacaacatccc

SEQ ID NO: 946 - DNA, 63 bp, Homo sapiens
tctttgaaagccatttttgaaaagccaaaaagagaggcctgtggaacaagcctggatttcatt

SEQ ID NO: 947 - DNA, 56 bp, Homo sapiens
cattttattttgtttttaaactatttattaattatcatgtacccattcatttcatt

SEQ ID NO: 948 - DNA, 22 bp, Homo sapiens
ttatttattttcatttttgttg

SEQ ID NO: 949 - DNA, 251 bp, Homo sapiens
atgaacatgattggcctggaggtgggaggggagtgcattgattgaaaagagaatgggtggagacagacagcgggagagaaagaggtgaaaaacggtccattaactgcctacaaaatgtggcattgggtgagcttcattcactgtggagtgatcctaaaatttttcttcccacgtggactcaattcctcgatgatagttgacccttgaacaattacagcccaccctcctgcacagtcaaaaatccatgtata

SEQ ID NO: 950 - DNA, 662 bp, Homo sapiens
cctgaatgctttttttccccaagcattcctcagaagtagtagccactggtaaaccaagccatatgattgcttaatttccaaagcatagttatatttaatatttaagtaaatctttcaagaagtgtgggtggctaaaaaagagatacctcattcgggatgtgggtgtgttttgatatgtttgcaatgggaggggtcgggacaaagtcaaaattggatggggacaggataggtgttaaaacctcagacgggtgtgagggcctctgagagtgtctggagctggaggggcctgaggttagcccatagcctgggctggaactgttgcagcagatgggaggcctggctgttgctgggaagctgcagggcctccatcctcccctcccagagcaccttgccatccatccctccacctgcccttctccagtttcgcagcaggcagccggagtcaagttcagcttttgttcagcagccccgagggaagaaagcaaacacccatgactgcaggggccaggcccccccctcctgtcactgggaccttgtgttccgtgtcttctagccactgctacccctctcctcctctccttagggcactctccggcctttcctggtccctaacaccggctttttcttatttatgtatttacttttattttattttctttctt

SEQ ID NO: 951 - DNA, 64 bp, Homo sapiens
aacaccgtttctttctttggggtcccaacagttggcattgcttactctgatcccccttgggctg

SEQ ID NO: 952 - DNA, 157 bp, Homo sapiens
ttacctggagctgttcacttggggcttcactgacctcctgcctttactttaggtttcaggaaaatctcccaagtgggaagattggggtttctagagagtcacagactccatacatcaatgcttcctggaaagtcctctttctctttctgtctttttt

SEQ ID NO: 953 - DNA, 51 bp, Homo sapiens
aaactccatgaggtcaggggtcaggcactggcagagtggggctgctcagag

SEQ ID NO: 954 - DNA, 52 bp, Homo sapiens
ggtacacacctcagtgggctccgaggggcatttgctctgattgattgattga

SEQ ID NO: 955 - DNA, 21 bp, Homo sapiens
gtgagccaccgcgcccaggtt

SEQ ID NO: 956 - DNA, 262 bp, Homo sapiens
gtgagccaccatgcctggccatttgctctgatcttgtatggcatccaggaggacaagtgtaggagacagttggaaactgaagccctgagctgggagatccgtttcggtctcttctctggagaagctcagaggacctccccacccccaagggtggaaggagagaagagttccaaggacaccctccttcccaaatgcctgtcactttccattttcctgccttggttcccactcctccctcctcttgtccaaacatgtctaagag

SEQ ID NO: 957 - DNA, 84 bp, Homo sapiens
gtctaagaataatcacggaccacaccgacgtgtaaatgctcaatgctcacccagccctaagccagtggtcaatgtgtcaatgga

SEQ ID NO: 958 - DNA, 25 bp, Homo sapiens
attctggctctggaagacctcggtt

SEQ ID NO: 959 - DNA, 37 bp, Homo sapiens
tccagggctccttctaaaatgccaattacctgcaagg

SEQ ID NO: 960 - DNA, 65 bp, Homo sapiens
tggctagagaatgtcagagctgcgccgggaccagctagctctttctgtgaggaacgagtcacagt

SEQ ID NO: 961 - DNA, 27 bp, Homo sapiens
tgtgtaggattgcagctccccagtggc

SEQ ID NO: 962 - DNA, 286 bp, Homo sapiens
agtgtgagtggcgagagccctgccggccgcgtggaggtgcgaggctgcggacgtcgcgggcccggaggcacctgcgcgcccttggccgactcggaggaggtggagatggacgcccgcgggtcccctggagatgcagccggcggcctgcgctggtgagggagccgggcccccggcgccgcgtcctcctcatcctccaggcgacaaggtcaggaggggccggggcggcgccccttccctcagcccccagcccccagccccctacctgggtcttcccattccatcccgt

SEQ ID NO: 963 - DNA, 87 bp, Homo sapiens
ctccggcagcgcccagccccgccctccggccgctccccgcggtccctccagaccctctggccgccgcctcctcttggaaccccgtgc

SEQ ID NO: 964 - DNA, 762 bp, Homo sapiens
cgccatgaagcagctgtgtctgtgcgcagccgcctccttcgcggtagggcccggggagggggcgcaggagcgggcggggcgcgggtacctcctctcccctcccttccccgtccccggctgacctggaccacccccccattccagacccgggaaagatggtcggcggcggggggtgggggggaacagaggttggggcagcttttgggggaatggaagagacatttggggagacatgtggacacgttttggaagactctttgaaacaaatggggacatttaggaacatttagagggcattggggggtgcagttttgggaaaacattttggagacagatggggtcattgaggggacaacttggaagctattttgggagagccgattttgcgaagaggtaatgatttggagaacagtttgggagaacatttgagggatgtttttggaggatatttttgggacatgacggtatcattgggaaggatggttttacagaacacttcaggaatttgggggagacatttcgtaatgcatttcaggctatagtgttgaggggagaagcctcgggatgtttaggggacagtggtggcatttcagggcagttgtggataaacagggcagaggatggtcctgagaggcatttaaaggggacttttaggggttcagatgggactttggagggtagtttggaaaagactcatggatccatttgctgggggcgatgttgcaggggtggctttcactaagggatgaattgggggacaac

SEQ ID NO: 965 - DNA, 993 bp, Homo sapiens
caggggacaacgttttggaaatagatgccagggggctgctcaggggatgatgctggtggtgggcttttgttggacaactggggtgatgggcctgggggcagatgctgggggtcgcaggcttgggggacactgtctgaggaccccctcgcccaggaccacctccccctgcagctgcggctcagccccactgaccttggctcctgcccgccctgcggcccctgccccatcccgaagccggcagccagaggcaggcgccaggcaagtgcccaggggcaggtggtgagagcccggagcccctgtcgggggcgtggggaggggacagcagccaacactgccccacgcacttctgggcgtgccctgcagagtcaagactggggcaagagtgacgagaggctgctacaagccgtggaaaacaacgatgcacctcgggtggccgccctcatcgcccgcaaggggctggtgcccacgaagctagaccccgagggcaagtccgcgtgagtgcccgcgacccgggagtgagatggctgaggggtggcaaccttgcggctgaacccttgtctctcacctccaggttccacctggcggccatgcggggtgcggccagctgtctggaggtgatgatagctcatggcagcaatgtcatgagcgcggacggggcaggtactgccagctgggccccggggagggaggaggaactaagcccaggtgcccagcctgagggtccagccagaccctgctcccaggtctcaatgttccccgctgaaaaaaggggaggctccctctggtgctcctcccctgcccccagggagacacacaggggcatgttaggatggggtggccaaagatagagactgtggctggcaccgagcaaagccagtggacagcttgtggatggggagtgactaggattcaggtattggttcagttggatggggaagtagctggcatggggaagtagctggggcttgggggatagctgcaaagtttctgggg

SEQ ID NO: 966 - DNA, 778 bp, Homo sapiens
tggggaagtttctagaaagtgactgaggcagaggaagaactggggcttgggagataactgggaccattggacgaactaagctttgaggtgcatctgggatataggagtatccgagataaaggaagtgactgaagggaactgcttggagtttggaggaggaactggattcatgggagtagctgagcttgcaaagtatctggggcaagagaataacaagtagagtttggggatatctgaggtatatgggatagctgggatctaggagtagctggagctgtgggagtagcttgagctcttggagtagctgggttacgaggagaacttgtatgtatgtatgacttaactggagacctggggggaataactgagataaaaatgtgtggccaaaaggagtagttggggctcaggaggcaactaggcatggggacacagtcaaatctgaagctttagggtcacaggcatggtgggcagggaatatggaatagctggggattcatggagcatcagacagggacagagttggcatttggaagaggaagggtatatggattggcaagaacatatacagcaactgtgggttgtgaagggcagagctgaaactttggtgtagtggaccctgtagagtatctggggacatggggagtagctgaggcaatagggcttgaggaataggtgggtgtggacagtcgctgagatgggattgtctggaatacagactagccatggcttagagagtctctgggtacagggaatagcatggttttgagaagtacctgat

SEQ ID NO: 967 - DNA, 382 bp, Homo sapiens
tactagggtttacggactttgctagactcagaaactcatcacaagtagttgacatggcttggggagcagctgggagctacttgaatagctggagctccagtaaatcttctttccttccccaggttacaatgccctccacctggccgccaaatacgggcacccacagtgcttgaagcaactactgcaggtcatttactgtcttatctcagctactcccttggcccctactactcctgagttccagcaattccttgaacccccagatgctctatgaatcctagatattccttggccccttttactccagaaccctagctactccctggataaccaggtactctcagaccatccacatgcttctcctatttaagatgtactccca

SEQ ID NO: 968 - DNA, 467 bp, Homo sapiens
tatatatatatactcccaatgccaggtatttcctgagctctgtttctccccaagccctgggtccttccttagccccagacactcccagagttcccagccactcctcaaattctcagctgcttctcagctctcagctattttcttttctcaccaattttcatgaaaatggagtcccttgggggccacggaagggtgaggctgaagtatagcagagcccagggtagggaaggcagtcctagagaaatcaggcagcaagaaggatggctccgcctcaaaggactcgccccatccccaggcttcctgcgtggtggacgtcgtggacagcagcgggtggactgccctacaccatgcaggtgggtgcagcccagccctgccctgaccccgaagcccagagggtgctagacttgggggttattctgcccagggccctagggacctgacctgctgtgaagcttcctgtctcctcc

SEQ ID NO: 969 - DNA, 410 bp, Homo sapiens
agcagtcgaatgtactcctgggctttgtgaggatgaggagaggtccctagggtttaatttcctttgtggagcccctaggagataccaggaaaaccatagctccaggcagctggtaccctcataatcacctaatccaaactccttcccagagggagggaaagggacccaccgacttgaaccagaactcagcccccgacctgtccgctgtccccgtgaaattcaggcatggctttcgctgacgactcaagaaacatctgttctttcggaaactcagaataaaatagggctttgggggttttagtcactgggtgagaattctctgcagttggagtatgctgccacctagtggcggcaatgcttctggtcacaatataggagtccgttggtttttgtcactcaacagttaactg

SEQ ID NO: 970 - DNA, 139 bp, Homo sapiens
ctcatactgcctcagacatacagcaggtattcaaacagagtttgttgactgaaaaatggatttttgtgcttaatcagactggatgtcaacctgctggaattcatacccagggattccagagaccatgcccttgtgtcag

SEQ ID NO: 971 - DNA, 39 bp, Homo sapiens
attagccaggcacggttgcacatgccttgtagtgtgggt

SEQ ID NO: 972 - DNA, 74 bp, Homo sapiens
aggagcagggtcacacccaggcagaaagtgcccagaaaatgtcgaagtctcaccctacccctactcttccccct

SEQ ID NO: 973 - DNA, 403 bp, Homo sapiens
ggacaaccttttctcttttgcagcggctggtggctgtctctcctgctcagaggtgctctgctcctttaaggcacatctaaacccccaagatcgggtaagcttctgggatctcttcagggaagatgttatgcttgaggtatgctgccaccaagtggcagtatctcaggcaccctttgaaagtctgagaaagtttgaggtgaaactcaagggcagttatataggcttctgcacctcccgggggtcagtttctcatgccatcgcatccctcctcctccctaccagtcaggcgcaacacccctcattatagcagctcagatgtgtcacacagacctgtgccgtctcctactgcagcaaggggctgccgcgaacgatcaggacctgcaaggcaggtgagcatctcccc

SEQ ID NO: 974 - DNA, 552 bp, Homo sapiens
aagtaagacgatctagccagcctcctcttcccagcctggcctgggtgctgaggtgggcatgggggcttgggggatgttctcatctcctcagtagccccctcccctggtaggacggccctgatgctggcctgtgagggggccagccccgaaacagtggaggtcctgctgcagggcggagcccagccgggcatcaccgatgcgctggggcaggacgcggctcactatggcgccctggcgggggacaaactcatcctgcaccttctgcaagaggcggcccagcgcccctccccacccagcggtatgcaagccccacctccccaatgcatttgcttcttggcagcttcttgtcactccccttctctttatcgtgaatagtttcaaggtacccccgattggctgcattctaggaggtcctagagcttacccaattctactcagaacagtttcaaggagccccagggcatttagagtagtctgggagggggtctgcttctgctttcctgggtcatctgtacagtaagaactttgcctgtcctaagaagggcaccccct

SEQ ID NO: 975 - DNA, 48 bp, Homo sapiens
tatcctctctttttaacagtcccaagtccctctctcagcactctaccc

SEQ ID NO: 976 - DNA, 302 bp, Homo sapiens; identical to SEQ ID NO: 1

SEQ ID NO: 977 - DNA, 1048 bp, Homo sapiens; identical to SEQ ID NO: 2

SEQ ID NO: 978 - DNA, 136 bp, Homo sapiens; identical to SEQ ID NO: 3

SEQ ID NO: 979 - DNA, 223 bp, Homo sapiens; identical to SEQ ID NO: 4

SEQ ID NO: 980 - DNA, 74 bp, Homo sapiens; identical to SEQ ID NO: 5

SEQ ID NO: 981 - DNA, 280 bp, Homo sapiens; identical to SEQ ID NO: 6

SEQ ID NO: 982 - DNA, 289 bp, Homo sapiens; identical to SEQ ID NO: 7

SEQ ID NO: 983 - DNA, 153 bp, Homo sapiens; identical to SEQ ID NO: 8

SEQ ID NO: 984 - DNA, 93 bp, Homo sapiens; identical to SEQ ID NO: 9

SEQ ID NO: 985 - DNA, 51 bp, Homo sapiens; identical to SEQ ID NO: 10

SEQ ID NO: 986 - DNA, 56 bp, Homo sapiens; identical to SEQ ID NO: 11

SEQ ID NO: 987 - DNA, 121 bp, Homo sapiens; identical to SEQ ID NO: 12

SEQ ID NO: 988 - DNA, 28 bp, Homo sapiens
gcccccacacatgccacacaacctagcg

SEQ ID NO: 989 - DNA, 542 bp, Homo sapiens; identical to SEQ ID NO: 14

SEQ ID NO: 990 - DNA, 183 bp, Homo sapiens; identical to SEQ ID NO: 15

SEQ ID NO: 991 - DNA, 25 bp, Homo sapiens
ccacgctgggaattgctggtcagag

SEQ ID NO: 992 - DNA, 695 bp, Homo sapiens; identical to SEQ ID NO: 17

SEQ ID NO: 993 - DNA, 724 bp, Homo sapiens; identical to SEQ ID NO: 18

SEQ ID NO: 994 - DNA, 29 bp, Homo sapiens
tttgggagtaaaaaaacagagggcagggc

SEQ ID NO: 995 - DNA, 128 bp, Homo sapiens; identical to SEQ ID NO: 19

SEQ ID NO: 996 - DNA, 571 bp, Homo sapiens; identical to SEQ ID NO: 20

SEQ ID NO: 997 - DNA, 123 bp, Homo sapiens; identical to SEQ ID NO: 21

SEQ ID NO: 998 - DNA, 59 bp, Homo sapiens; identical to SEQ ID NO: 22

SEQ ID NO: 999 - DNA, 44 bp, Homo sapiens; identical to SEQ ID NO: 23

SEQ ID NO: 1000 - DNA, 204 bp, Homo sapiens; identical to SEQ ID NO: 24

SEQ ID NO: 1001 - DNA, 81 bp, Homo sapiens; identical to SEQ ID NO: 25

SEQ ID NO: 1002 - DNA, 287 bp, Homo sapiens; identical to SEQ ID NO: 26

SEQ ID NO: 1003 - DNA, 771 bp, Homo sapiens; identical to SEQ ID NO: 27

SEQ ID NO: 1004 - DNA, 137 bp, Homo sapiens
atttttagagaaagatctagacatctctgctttttctaggaaaaataaaaacataaaaactaaaaaccccgcaactctcaggatagaccggattatgctgaggtaacaaattaaccctaaaatcccagtggatcatc

SEQ ID NO: 1005 - DNA, 460 bp, Homo sapiens
ggtcatgtccctactgtagaagacaaagaggacctcatagcattcttctatgcctaggcccagaatgtacattgtcccacttcagtttatagcccattagctagtgcaagtcacaagtcccctaagtaccaggaaatgtggtcttttctgtgtgcagaaacaagagaagaacaaaaaaagtatgcaaacacactcacatcaccattgcctacattaagattttatgcttcaagaagagtgaagccaacagaaaaggctgaacataaaggaaatctctaagcctggacacccggtggatccagaataaccaaaacataattaaaatacttactgagcacttactgagtacttttctcaagattaatgcaaatttctattctgcctttaattccttgatttttaaaaatattttaagatttttgccaagcttttacattttaggttataaaagaatttccaa

SEQ ID NO: 1006 - DNA, 893 bp, Homo sapiens
gaaaagaaaaaagaaatgatcttccaagaagaaaggttgatactaatttttaaatgtaaggtcaatcactacttggttcacattaaattttctagcaaatcttgtgttcctcatttgcaagatttgcttctgatttgctagatttgcttccggatttcccttggtttgcttctctttgttcagaagataaattcacactcaaagtagcacagggcctgacatagatgtaaatgctaagcatatataccaatgcttaggaataacaaataaatgagtgtgaaattagaagcatcactaccaagaatatttatacaaatatctagacttatactccatgctacaacaataaaatccaaaatcaatgtgtcttacctttcgcatacgatcattaatgccaaagggcagtactgatttcattaaaagaacaattagaaaagatgaagagagattttcctgttttcctccaattttgaatctgtcctccttttcccattttccccattttcacagattcttatgataaagttttcatttctcaaggagccaacgtcaccccagactcacacaagggaacacaactgtgttatcattgcttgtctgaaggaagggaagtcaccaatcctccttcaaacaggaaaccttgtggaaaataattgtgaatgtagagcacacctgagcagaaaaaaaatgctgaccagaactgtgcaataagtttcttccatgttggaagagtttgacttacaactcagccattctctgctgcttatataagagcaaagtcacgtcaaaaaagaagccaaaggaaacagaatgttctccattgcaggaatgactgaagtttcgccaattaaacttttccttaggcatgaacataagtaataacctaacatatc

SEQ ID NO: 1007 - DNA, 246 bp, Homo sapiens
aggttattgaaagtggaagtaatgctcccagtatttgtgcaggataaaaagaaaatattaaattatttgtttttgtttattttgtaaccttattatttagtttacttttttgcattttattatttacatcatactgtatatagtatattggtacctatataaaataaatatatactcacacacacatatgttgagagcatacgaatagcagttgcagctcagtttatttttaatcaatgagaaagg

SEQ ID NO: 1008 - DNA, 3168 bp, Homo sapiens
atagtccggcgtgatcattaaaggaattccttgtgttcaaagagcagtgcttgaaaaccaagctcatttgtgcctgcagaaatgccagcctctggggtagaagaaatgtcatactttgatcatcttccacactgaattaggaggaaaagcagaagaaaagaaactgagggtaccaatgccagacagtcactaggtagtaaatggaaaagaatttaaagaaagtgaaaatcaaaggaaaatatcacaacgtttggttgacaccctattcctcacccagccccttaatgtctttctacagaaatcagatttctggtgcaggcagttcattgtttgaacatgcagtaatggacacatccagattcctaacactggggagttcagagtcaatcaacatggattgagacacttacagcttcatcttttgctgattgagcactgaggggtgtgtatccccatgcggtccctaagagctacacccacgggagaaacattttatgttgttcaaaatacttggtgctatggttgttatcttcaattttcttaactagtaatgagtgatcctagtaagtgttaaaccaatatgcactaggctctctttaggatattcattacggaaggctttgaagctgagaaagaagtttagagtttagggaaaatttttaaaacaactctatattataggcattttaaaaaataagtgcaatggaattctttagaggtaaccaagtttctcaggatatctttgaggcagtgataaagatttaagtttttaaaatcactatcaaacccctttgtgcaacatttgcataaattctcaaacaatgggactgttttcatgtaaatttgttttcagggagattcctgctttctgaaggcagtgtaactgtagctgagttacataaagtgacattttattgcctcctgtggaagatgctttgcactaatgatctgaaatctgatgtctcaagctaggaattagatgatctgtggctcaaagtgtgaaaagagaaagtggggcctttatgttttagttaattacttctggctaaaatgtggggagcgctccctggaccttctgggactcctggaatccggaaacctgtctacaaaacctaaaggattgaagcagttgacctcatcacaggagtgaccacagggggaaaaaacagtgattcacaaatccaagcctgatttcagtcagaaatttttctgtgtttcataaatctgccttttttctctaactgcccttgccacctagcaagccaggaacagagagaccaaaaatcatcataaatatggaatatgcagtcggaaatgtgaaaaaagagcttgctacccagggagaacaaagctttcacccctctggggcttcactgtgaaaaagaaacaactctgcttgttttgtcttattttcccagatacttctatttgaaaaatatagtaaatcaattaatcaatttttctctccctactatccacgccccctcatttctccagttctctaattctctaattcctgagttgtctaattcctgagtactcctagggcagttcagcttactacaagagaattttttgtggctgttctcaaactccatattctgtttgcagagaatgctgttccttaattctgtttgagtttcaaagagaaaaagctcataccagtttagattacccacaatcctcaatgcatatcgaacaaaattgtcattcctaatggcaaagttcaggatataactgtgttagttaatttaatcatttaccatgaaataccaggtgtcttaatcttatatatagttcttaagttggctgcatatttttgtgcaattgaatactgaccctacatgaagaatacaagaattttgtttttaagtaaatgttgttagaaataaaatgtttctactggaaaaaaaaatatgttattagaagcactgtgaatttttctccaatgcttgaagagtgaccactccagcaagcctggcttatgttggtggcattctgccctgccactacctccagcacatccacagacctttatttttgttattttatgaccacatgcaggattctggcaccaaggactccatttggacttaggaaaagtagaagagcactctgaaaactggacgtcgggaattgatgaactggcatcgcaccccaacaacacactctgcttgtgggccttactctccagatacctgatgtattactggagaagcaaatgcaacaaggcaaagatgtcttcattttctgtcaaagcaaggcctcaactatggtgtcattgaggccctgaatctccgcagccagccagtcagaccccatcaacagctgcagcaagcagggctgaggaggggaatgggaggcgataggagccaatgagggctgagcccgcagctctgtgtctgactggagcagagagacagagaggccagggccagaggaaaccccagcagcaagggaaaaacagattgactctcagtgactcatttagctcctgggttggacagatctctcccctgctggcaatttggctctgcatcaatagttcgaataccaggctgaacagcttcaaataattagggggaaaaatctgcaaaactgctagccatccaattctttactctgtgctgaaagacacagtacaaatgacatctaggttattaaatatgaagtcactggatttgctgcccatttggtccaaaggcagaaaactggataaaactcaaatttataattcagtgtagatggcctgtttgtccttgaggcgatccatgaattttggctgggcaggcgctgtgaatgtggaagtaatgtcgtgggggaagggggatgaacaaggtttgttccccccgccccgccccgactcggcttacaccccctggggaaaaaaaaatgaaaatgtcaataaagactgtgaatgtgaagagaaatggaatctgagcccagagtttagtagctggcagtttaaactttatatactttaggccgacaggcgtctggatctcctgtactttatatccagcgtacaaaaactgaagcaacaggctcatttggtatcagtaaaggtcagttaaaattatagagacattttttggagcaaatctccagtcttgtatttgcatatttatgaactagagattaagataggccattccacttattagagca

SEQ ID NO: 1009 - DNA, 346 bp, Homo sapiens
ttggcagggtgagccggtggtggtggtggtgatggggcttgggaaaccaacaaagacatttaaatcaagccaactgtttttacattggatattaacagtaaatatgaaatcagagattttgaggggagttggtgaattcttctcctccctcaacacccccccaccaaattatctttcccctgtcttatccttgtcagtatcagggctttcactctctatttaaagggaagactctgggattttagggcaaagatccaaagttttggcttggcaaaatagttttcctcacttcactggaattgtgggggtaggggagagcatcagagtaaagcaaagatgttgaaga

SEQ ID NO: 1010 - DNA, 1029 bp, Homo sapiens
ccatcacactggtaccaagttttcacaataaaattacagactcaatagctggttccatgctttgctttctctttttggccacttgggatatcccctgcacagaggcacaattgtgagtgtgcttagctgcattctcaagagaaggcactgctatctagggactccttatcacataggaagacagcctgctctttccaaaccaaattcttgtaaattcactggacactaacctgtcaagtaactcagtgatattcaaagatcctttgggatttgaggagaaattggaaaaagagaaaagaggaagcagcttgctttctcaagtcattcattcaaaaaaaaaatgagtattggctcctgttatatggctcctcgatgtgttttagaaaccacacaaacacatcctcaactggacaaccatagagcaggttgaaaaattcctactctacctggcggagtttccagcccctctgcagaagtgcacacctatgcaaaaaccttcatcagaagagaaccttaagggatagtctgacagtagggaatcccaatgtgtataaccagtggtccttgctatctgactccgagagctacactgagtaatagaagcaactctccttgccctgtcttctaggtttctattatacttggagtaggtaagctttattttatttgctcaagatatgtcacacccctggacacacagaataaaaattcaaagtcctcctggaattcaagatgtgtcatacccctggacacacagaataaaaattcaaagtccgactagagaggcagagaatatcatcactgtatcactccattttactttattgaaaaccttaaaagtaaatataaaacgacaaattacggtgctgctattgttgcttgctgtctgggaaaaaaagaaatgttggataagaaggtcaaaatgtgccaattcaatgccctgagaatggtcacctaatcttctatcaagagatgtgacataccatctaaagaacggctgcccagccaggcgcagttggtcacatctgt

SEQ ID NO: 1011 - DNA, 324 bp, Homo sapiens
taagtagagaaagaatgactgccctcaatgcctaggagcttgactctgctttacttctgccctttcgattctctgtgaaatgaacaggacttatgtaattgctttcagcagcatctttgaattacaattacataataagacacacaccaggatgtgtgtaattgtgtaataacagcatgcctcactgtgctaggttggtggccaataaccacttagtcatgctattatattataagaacatatgccctcaaggcatgttgaaattattctggggatctctaaaggaaagctgactgatcaaaagagagccccaacttaaaaagc

SEQ ID NO: 1012 - DNA, 823 bp, Homo sapiens
ctgatagtaatcccaacaagaaacaaaaaaattacacctaccctaaaaacaaacaaacaaaaaacctgtagtgtaaaatcaaaatcaaagtgttgtgtaatgattcacttacgtcaccacaggatttaagatgacagagtgttaataaggaaaaaacaagaagctggccagaagtcaggtgtcgtgatgccctcttcatagttggtcagcgtgaagactacagaggagttatgtctcaacccagaaagttctagcttctttggagcctactcattcccaagaaaatgacaccccaaaggctctataaactttccacactttgaacttttgtgttgttctcatagtcatcagatcaaaaaataatctcagaaatgtgagatcagacttttgcagttgaatctccccaatgatattttccttacagtgaaagtatgtgctaggataaattgcccacactttattcttacagcacaagatacatatatgttatatatatagtatgtgtacatacgtttcaatacctaatttttctgtatatgcaaactacatttccatctcttccactcttctaactcatttggcaggaaaaaaacctcatgcaacaaaaataaggcagtatgagatgaggggagaggtgggagagatacttttgcaatttataaaatattagtttgtcacttcttagataaggctgtatcaatacaagttataatatcgaggtaaacataaatgtatatgtgtaatatacttgtaattcacaattgatgttttgttttttccttatgcaattagaaccttaaaatatagaagttttgatcattac

SEQ ID NO: 1013 - DNA, 427 bp, Homo sapiens
tatacatttattacattattatatcaactgcacatttattacatcaacaaacttttttttaaacaatgctgagtataagtaatgagaatataatggagaggaaaacaaggtccatgttgttttagggcttatagtccaccaaaaaataattttgacaggacatgcataggaaaggcagcaaatatagttgtgggttttaatccattacgtatgtggcatttccaaaataccatatgtaagctgattttaaatattttcagtgatcttaaaggacatcaactgagtatttcagtcaccttaacaaccaaaagtattcaatgattcaacaaatgacctgcaactaatgactcaatctaaacccaatctaaacctccattgagttaaatttgaggaagtacctacaaaattattgttacctctctgcagg

SEQ ID NO: 1014 - DNA, 268 bp, Homo sapiens
acccttcacactgcccactgaaggctccacttcaagtctgccctcctctggagccttttgttaaatctttgccagcacaccattcgtcagggtgcacccccatcaacaagacagcttaaagacatttagaaagcaaaaccatgacagaaaatgtcaaaggggaagagaggaatatacaaatatggaaataaaataataaagtggaagattctgatgtattaagccagagcagcagttctcaaatgttatggcctatatccaaatcacc

SEQ ID NO: 1015 - DNA, 1156 bp, Homo sapiens
atcggtatggctttttctcctaacaccagttcgtctcctgtgcttaccacctggttgaggaggggtggaagtgcatggcaggtgtggctaatgccattggattggcagctcttggtaaaggaaatcgatggccatgtataaacaatgtttaagctgaagtccagtgaaatggtccctggggacccacaagctgctcacagccaggaaggcagcactgcccaatgttgcccccaccatggaagaaaaagcatgccaaacaccttcatctagccctgaaggtattttcactaggcctatgtagaaggtagtttggctaaaacagcttcagttggcatatgcagaaagacacaatcttagagccacagtgaattatttgtttggaaggcaggaccctattaagacactggatgttgccttatccatatctggatcaccacaatgcaaaccatgcccctggagacagaaatctacaagccacaaagacagggagaaagctaacatgacattactgggaaggtgagtatacactaattagatctcacaaaataaggatgatagaagaattccattgtgttcacatttcttaccctctgtaatgttgaagatctgaaatttggttgtaaatacattggtaacttttttgtccaaattacattcccaagaaacagataaaaactgaacacaggttgaagtttggctgttttataagtatgcagttactgaaagcactggtgataacactgtcagaagtgaaaaattatagatgattaataagaaattgttgaaagaaatggttcttgccaaacaaaacatcaatgagattgaaaacaattttcattgacaaaacatgtgcctgttgggcattccagaggagtgtgatgagaataaatttgactgaacctttaaaagagtttttacttgttgggtcagatctttctgctaaatccctcagtgtcaaaatgctgttttgcctttcctacctgctctgggcatactccgtcacaaactacgttgtgtgaatctgaggactgctttagaaatgagttcccaaattgctcaagaaatagttcaggctgtaattctgaaaagccttctgctcactcaggtcctgtggggggagtttagccaataaaggaaagaaagaaagaaagaaaga

SEQ ID NO: 1016 - DNA, 212 bp, Homo sapiens
ttaaactctttcaaaagcaaactttggaaccatgacaaacatggaagccatgtgtataccatgctgtcagcatttcctgaagaagctgtgtgtgggcttcagggagggctctgggatgataatctggaaatgatgaagaattcttttatgtattttattgtagtacaggtctaataaaagctaagtattataaatgttaatggtgcattaat

SEQ ID NO: 1017 - DNA, 54 bp, Homo sapiens
ctagaaccctaattcaaggaaaacattctataaaacttctagccaaatgtctaa

SEQ ID NO: 1018 - DNA, 638 bp, Homo sapiens
gcttttaaatcactagtctgagcatagtttagatttaaataattattctttctctctctttttttttttaaagattcagattcatagccatgcgatgaatgctactgttatcattgacatagatgaccagcccggaaataagattgtatgaatagtccatttagttaaatgtttcggccacttagatctatgtgaatgtgagcataaaatgtggaaacacttaggaaataagctttcattgtatagtataatagggggtaatgagattcggtcaatctgtcagagatttaaacctacccgatcctaaagaaaaacaggcctaaaatatttcaaatgtgaggttatattaaaagccacagtttcaaactgtgaagctaaagaaatcagttgtttcagtttattgtctcagggaaagcacagtgtaatacctgaaggacttgaaagagaaccaaaaggaggggtagcattcccagcagctagcactttcatccaatgccagggctttcattggccaaattattttcaaagatactgcctgaccgaagcacttctgcaataaaagtatctctgtgttagtcaatggaatgggggaatgttaaaattgaaagaggcctttgagaccagctaggtcagtgtcc

SEQ ID NO: 1019 - DNA, 250 bp, Homo sapiens
cgtaacaaaaacaaactacagctcaggtcaactgaccatcagtatagtatgccttctaatacactactgtcctcgcactttttgtattttaacgtaatggttttaaaatgcacatgggaaaaataaatataaactataatatagaatacaaaagctcccagagaagagtttacttcctattcttgtactccaagtcccagttactctcctcagatatgaccactgtgctcctcagatatgaccactgtgc

SEQ ID NO: 1020 - DNA, 89 bp, Homo sapiens
tataactactgtcagcagttcctctgatagtctttcagagatgctctatgaacttctaagcaagtgtatatatgtgtgcatgcatgtgt

SEQ ID NO: 1021 - DNA, 200 bp, Homo sapiens
aaagaaaatatagtcattatttaagttttatttgtgatttttttcttcacttattaaatgataagttccttgaagaaagaaaccatagcttctacaacttgattccaatgcccatggccacacatatcatcattctttaacaaagattgaatgaccaaaactgtgctaaagactgaaatacaaaaatagatatatattat

SEQ ID NO: 1022 - DNA, 167 bp, Homo sapiens
tgcatttgcttagggcaggtgggggtctttcagggcagaggaaacaagacttaaagctcagggtccaccttagcttaagactcagataaaccacctgccactgtaaggtagaacctagcaaggttatcacttcagggtaagggtaaaccagaattaaaccagtcctt

SEQ ID NO: 1023 - DNA, 133 bp, Homo sapiens; identical to SEQ ID NO: 108

SEQ ID NO: 1024 - DNA, 207 bp, Homo sapiens; identical to SEQ ID NO: 109

SEQ ID NO: 1025 - DNA, 1137 bp, Homo sapiens; identical to SEQ ID NO: 110

SEQ ID NO: 1026 - DNA, 112 bp, Homo sapiens; identical to SEQ ID NO: 111

SEQ ID NO: 1027 - DNA, 905 bp, Homo sapiens; identical to SEQ ID NO: 112

SEQ ID NO: 1028 - DNA, 40 bp, Homo sapiens
tccttttagtaatcgtaacatcatgccattcaatatataa

SEQ ID NO: 1029 - DNA, 4108 bp, Homo sapiens; identical to SEQ ID NO: 113

SEQ ID NO: 1030 - DNA, 32 bp, Homo sapiens
caacaacaacaaaaaaaaacaaaaaaaaaccc

SEQ ID NO: 1031 - DNA, 765 bp, Homo sapiens; identical to SEQ ID NO: 114

SEQ ID NO: 1032 - DNA, 26 bp, Homo sapiens
acttccagttatataacttcaatgct

SEQ ID NO: 1033 - DNA, 596 bp, Homo sapiens; identical to SEQ ID NO: 115

SEQ ID NO: 1034 - DNA, 74 bp, Homo sapiens; identical to SEQ ID NO: 116

SEQ ID NO: 1035 - DNA, 338 bp, Homo sapiens; identical to SEQ ID NO: 117

SEQ ID NO: 1036 - DNA, 162 bp, Homo sapiens; identical to SEQ ID NO: 118

SEQ ID NO: 1037 - DNA, 67 bp, Homo sapiens; identical to SEQ ID NO: 119

SEQ ID NO: 1038 - DNA, 251 bp, Homo sapiens; identical to SEQ ID NO: 120

SEQ ID NO: 1039 - DNA, 838 bp, Homo sapiens; identical to SEQ ID NO: 121

SEQ ID NO: 1040 - DNA, 672 bp, Homo sapiens; identical to SEQ ID NO: 122

SEQ ID NO: 1041 - DNA, 1722 bp, Homo sapiens; identical to SEQ ID NO: 123

SEQ ID NO: 1042 - DNA, 46 bp, Homo sapiens; identical to SEQ ID NO: 124

SEQ ID NO: 1043 - DNA, 25 bp, Homo sapiens
tgacagaagcacaaattggtcattc

SEQ ID NO: 1044 - DNA, 386 bp, Homo sapiens; identical to SEQ ID NO: 126

SEQ ID NO: 1045 - DNA, 537 bp, Homo sapiens; identical to SEQ ID NO: 127

SEQ ID NO: 1046 - DNA, 37 bp, Homo sapiens; identical to SEQ ID NO: 128

SEQ ID NO: 1047 - DNA, 2161 bp, Homo sapiens; identical to SEQ ID NO: 129

SEQ ID NO: 1048 - DNA, 1512 bp, Homo sapiens; identical to SEQ ID NO: 130

SEQ ID NO: 1049 - DNA, 150 bp, Homo sapiens; identical to SEQ ID NO: 131

SEQ ID NO: 1050 - DNA, 2942 bp, Homo sapiens
gttttgtgtctcagaatgtgtctctaaccacatctcaaaaccaaatatgataaatgactttcgtcttatccatcatgtttagttggctaagcctcttcctctatcagcccagataatgaagagatgggatttttattgttttctctgtggcacagagaataaagcaagttcccaggtaacaaggcacagcagcatctttcaagccccgaaactgagatggtctgagaagaacaggcacgtctaggagaaacagaaaggaaaagccagccggaaaggggaatcattcttaatcgatcccaagcctctgagagctggaaggtctgactgcattttacaaataaaaaagtcaaagccccataaaggaaagtagcctaaagccacagggatggtgaaggagtggcgtcaggatgggcagaaagagctctggactcttgggctgctgctacaaccacctggtgtgggttttcttaacaccacagctccatcaggttcttaggaaaaatgtcacacaaccaggttgtcaaaagggctttgagggcattaagaaagggacagaagtggatggattagaatggacaggtagggtaccaaggggccagagtgagaatgaggaagaagggctgaagagagagggatcagtcgtatttgcttctgtttctgaatagtttccctttttggaaagagaagtaagagaatagaaggctaaaatcatgccacagactggcaggggtggttgggtgtagacacaacagctcaccttcaggctgctttcacattcattcatctctttcccttataatgatgatgctgcctccagtttttagaactttctggaaacttctgagaagtgactgtctaaagggggatgatgggagaaggggagttgcccatgggttcccatcgtgcttgctggagcaatgggtgttggcagatttcttcagaaggaggttgtcagcagtggggtggggctgggaagaaagccacagtgaggcaacaggtgcaggcatggagaccagagcaagcacagtgtccgtggagaacggcatgcatgtcacggcaaccactggagtgggcgtggagtggagcatggcggagagtgggggtgaacaggcaggcaggagctctaggtctgtgtactgcggtgacacttctggattctactgtgaagacaatagagggccattaagaggcttaaagtgagggggtggtagaatcctggctacatagacctcccagcactcagagccttggaatcttgccatggtggtacatgtgtgtgttgggggtaattagggaggaaggggtgaggctgagctaggatgactagttaggacaccatctttactgtctagaatatactgagggctgtgacctgggctgtgtcagtgggaccagaggaggggacagatacaaaaaatacttaggggtctttaaacttgggggatgagagggaagaatccaagatgaatcccaagtgtaggggagggtggcttttttcaccctggatgaggagcagtctggtatggagaggggatgagggtggctctggctttggcggttgggtgtgtcttttggactgggtgtggtgccctatagaaaggctggagcttgggacaggtctgtgtggacacctcgattcatcactgcatggttggtagttgaaaccatagacatgggtcagattgtcccagtgaaatggcagagaagagggcaaggacagactccaagaggccctgaatcaaatgggtatggaaaatatggagggcctgggatggaggctgagagggagctggcaggaggggtgggggcagattggttgagaccattagcagggaaatgagggagaaagagtttccagaagggaatggttaccaggttcaaatgtgagggaggaattcactgctggcatttgtttgagaagccctgacctttttctgttcccttgctagaaataaatgctttttttttttggtagcagacagtaatgtactggaatggaatcatgattgttccgtgtctcagaatccatatgtaaagtcccttgtcagatagcagggaaacagtcatctttgggcagtttgtactgagagggaggggaggccgagtgtaaaggatcggtgccttaattttagcaaggctctgagccccttggaaggcaagctttatttctacatagattgaaagtattattattattacatccttacgctgtatcagcgccaaacactggagtcctcaatactgtatttatttctctgggcttttggaggggtggggaagaaacgggacatttaggttgctaagtgattgtgcttgcttctaaaaataatgagattccccagtggctcgttctcctgtgttttgcttagagttagaggatgccaaggtcaagttatagatgacaggctgtgtctccaggtggtgtcagggcatcctgttggggaaggacaaggtaaactctccctctctggtcctcccacctgcatccccttagggcccactactttgggaaattgcaggaaaaactgggcctccccctgcttggattgaagagcctcgcctaggcagtcagactcagtggttgccatggtgatggtgggtggttggtggggtggtgatgcagcgtttggcctgtgcagctgaggtcctcaatgcaggctgcttggagcccaggctgctgaagcttttgacagtttgtttaggattccagagggtcacttgctgcggtgttgaaatcttcagacagacccgccagctcagccagctgaaaccttcattgttgaatatgcatctcacaggccaaattttggcaggcgctcatgggattaggagctccacagcaaccttggtgggggaaggggtgtgcgaaaaagctctgtgcaggggagagtggctgggataatagactctgaggacaacagaaggccagaggcccttcagat

SEQ ID NO: 1051 - DNA, 177 bp, Homo sapiens
ttggcaaaattctggccccttctaatttgattcactgactcaagttatgccaagaaggaaagcagtgtaagctttcatcaaagtgacaaccacttgccacccaacaaaacattcatacttttctcagctacttctgacattatttcaagaccccttgttatttccccatcccctata

SEQ ID NO: 1052 - DNA, 29 bp, Homo sapiens
gactttagggtgacacccatgtttgtgaa

SEQ ID NO: 1053 - DNA, 76 bp, Homo sapiens
tataatagtattcatagctttttttttctgtttttatatccaactatctacttgtctaaccaattaatcactgatc

SEQ ID NO: 1054 - DNA, 22 bp, Homo sapiens
tttgcagggacatggatatttt

SEQ ID NO: 1055 - DNA, 104 bp, Homo sapiens
tgaatttagttgttattcagtaatccatataatttgggaatgattgttcaaatggcacagactctgacaggggttcaatctaccattgtgtcagtgtagcagat

SEQ ID NO: 1056 - DNA, 41 bp, Homo sapiens
ataataagaaacaatgccaatagtgatactaatggtcctca

SEQ ID NO: 1057 - DNA, 195 bp, Homo sapiens
gctttctcgttgctcacacactgtgtactgacgtacggctgaattctcctgggattgacaatgagcttactggttatcactgtagagtcttctgtttggaatcaagacatttgctcaggttttaaggcctctgtttttatccccagtttctcacaagctgcttgtttggatgtcttatcagtgctggatctaagt

SEQ ID NO: 1058 - DNA, 2834 bp, Homo sapiens
tcagttgcagacacacttgagccatttttgttatttaaaatggttaagtgttcctactagtattatctcctatccaagtttcacttttaacagaatttatcctcccccttttagatttttaaaaaatattcataagacactcagaggtatgactgaatgttggtcactagacccagaaaggggtatacctaccagctcttgcccactgagttgtgcttgaggtggaagaaacagaattgcagactccaggaggaaaaggtatgcttctagaggtctttcatctagagcgaatctttcccaccttctcctaatcagcagaaatcattacaggaacaagacatatcgatcctggtctgagggcaccatatacatagagttctgttttcttctttttctttccaccctcccccagcctcagaaggctaatccagtgccacctgcgatttcttctgatgttactgtggaagggagggttacataaagagaataaccaggttttctcctgtggcacctgcagccccattttctcattgggaaaaccaaggtatgaaggaataggttaggacttaatggtgcataaactcagagccagcagtcattcttccatccctggtcttggcatttggaagatgtgatccactatgttgtaaggtctaaggggcaggaaatacaagatgatgtatttatgtaaatataatgtactatgttgtaatcatatgtgcatgcaggaatgaatgactgaataagtgaagggagaattcttttctacctgaactgtggctcctgctagtctgaaaggcatgcagcctttcttaagctttatgaagaggaaggctagaaagaagttcagaaaagcttcccccatctttattctttaaactctatataaaggcatgaaatgttctgagactgacgaaaacatgggcctagaccagcaaatgattttggaataacaaagatgagcctagttctctagctattgtcacctcctttgttgtgccagtggtggttaccatgtgtcctccttcactggaggatacagccaaagtgaaggatgctgcagtgtaaggatgcaggatgggttttctggcttcaaattcgttatagactagagtagcccagggcatcttcttactagatgtcttgcatcatggcagcaacacccctggtccctctggggtggatggggtgcagcacaccttggtgaggggtttacactaaatactgctgaccccaggacagcaatttctcatacatttttattccaaagtattcctgaaaggtacttttgcttcctcatgtttccacaacaaccccctctagagcaaggatataaataagaaagcaaaatttcaggctccctttacaatcacagtagctgttaactgctgaaagggactcagagaggggcccctgtgggagggggaggcagagggtggagcaggccagcctgtctccctgggtagcacatccccaaagaatcctctgagcattgatctttgattgtgccccttccgtgctacccagcaggaccttctcccctaaagaggggtcactttgtattgaggatctccttcttatattgcatttgcttagagggtgcatggcctcagaccacattttggggctgatgggaagaagttggggcaggagggcactgtggtcataatgaggtcatggactgctaaagcttccagttctgaggggctcaggtttctcaacagagtgaagatcaaagtgtgttcagtgtggctgctgctgctgctacaaagaggtgtgaaatgtgggtttggaaagagaaccgaggataatttgctagtttatagcctttcctagagttcacacagaatttttagtactttctctccctcccttttttgtaactgtttcagagaaggtgtgagatcagcaggctgtgaacatcgtgcagtgtgggaaaggggagctgaggcatgggtctctgtctccttggccctgggagaagggattttggtgggagctgggggagtgtttgggtgtcatcttggggagcatgttggggagtgtgtgggatcaacattcccaccaccttcctccctgtcacctgggtgctggcttctggaaggctcagccctgcaggtccatagcaggactttcctggctgtgccgtacaaagtacctgacgatgagattgcttggaagggcatggggaggagccagtgacagatgtggtgggatccatagaaagggctgctgtggagcctctgcgtattactcaggagcacctactgagttttctgtacagcctttgttttgccctctggaaaatgccaccaggagctctaaccttactgtgatcaccctttgccattcagtgcctgcctccattccatctgacagctttagatatttgaacagtcctcttgctgacagctgtgtggagcaggagtgtcctgttcgcatgccaagtactcagactctgggaagacagagataatgaacttccttttcaccccagtgattgcctccgagttcagaactctgtgccctcgcatcaggctgtggctgagcctccaacttgctttgctcccttggcccagcatctctccccttcctgtctactttctcaaccactgctgggagaccttcctaaagcatagctttgctcatgttatccgctgggcagaaaccatccatgggtctcagtgctcatgagaggagggggcagagctggctcagcggcactctgtggggaaaggactcgggttatgttaagaaagtgagattgctgccaaaagggatcccaccctctggacctgctgtgactgggattccaggccttgaataagattcag

SEQ ID NO: 1059 - DNA, 142 bp, Homo sapiens
agttcagggatgggctgtgctgccctcactgcaagagttcatatagatgctgggatgagcttcgcccaggaacactgtgttcctggagtttgggcttgattttctaagatcatatccaacttgaagtttatcagttcaccct

SEQ ID NO: 1060 - DNA, 227 bp, Homo sapiens
gaagactgagggaaagggtggtttgggaaaccttcctgaagcaagtgcatgctgaacagtgttgaggaggagcagtttaaacctagccagggtgaggtgcatgcgagagccctgaaatgtgaaagctgggcacctgcaggaaaccaaaattagttcaggtgactggagggtggcaggcggaggcgtggcaagaggctggaagacaaggtggaagacagatcatgaca

SEQ ID NO: 1061 - DNA, 111 bp, Homo sapiens
aggtattcttgtgaaaaattatgaggacgttggcagtagggatagagaaatgaaactgttaatagagaaaaagctatggagttcctacaagacggtcttttgggaaagaca

SEQ ID NO: 1062 - DNA, 33 bp, Homo sapiens
agtggaaatgcccagcagagtaccaggtatgca

SEQ ID NO: 1063 - DNA, 186 bp, Homo sapiens
ggtctgtcctggagataaagactgggagtcatttgcatccaagtgatagttgggcacttcgtttcagtaaggccttttagggagtgagtgtggattgaaaataaaagtggggaaaggcaagtatgaaactttaggaaatgtggcttttaaagggaagtggaggaagaggagtagccaaaggagaaa

SEQ ID NO: 1064 - DNA, 674 bp, Homo sapiens
gaggaatttcaaggagagggtactaaacactacagagttattataaagtgctgcaatacaataccgacaagtacatcttgaatttggagacctgcgggcctctgatgccctgtaatgagtcattttcacggagtgaggaggacagcagccaggggcagcaggctgggtaggtagagggtacaaatgtgcaccagcttcagaagctggaccagggaagtgaggaggctaaggaggggccacagagatgcagggaagagctgtgtcagaagagagcacacaaaaagttgaggaaacaggagagggggtcatcacagagctgctgaaggcgtgggatgcagagcatcgacattcttctgcaatgtgagaaaaagggtcaccagcttttaggagacttcagtccacattggtattagaaagttttgattgtttaaaataaggatctctaatgattatggaagagctattttttttttctgtatttgttgacctttagtcatatttgaagtttagcaatcagaacatgtactacagctcttaatttgaatgtaaactcaccatccaggcccacctagacagggtcacaaagagttgcttttgtgaagagctctcaatatttttgccaacttcagaaggttaggaagatactgcaaacaaccttgcttttttttttaagt

SEQ ID NO: 1065 - DNA, 480 bp, Homo sapiens
acatagaaatttgccatggctgtatctctacaggattagttctacagtatgtgatgctccatgccaggatcagcagtttacagtattttcataaaatcttaacttggtcttagcctcgtttctttcactttcggaggtcacgagttaatttgcgtagctggcaaggtaaaaataagagttgaagagaaagatttttgccctcaagttaaacttggacactgggtgtcagcacttctgtgagaggcagacatctctctgttgttcctaataaatagaaaaagtgttcttttaaattcctctctgagaaaatggccatgccacttagtttccctgttgtgagagtaacctcttgattcctctaacaactcagcattttatgtgttcacaatgaaagtacaattaaaatcacttacttcatgcttgcatagctctatcaaatagattcaggcagcaaacagttcctgtatataggcacaattc

SEQ ID NO: 1066 - DNA, 815 bp, Homo sapiens
ttatcttttattttattccaaatagatggtatgggatgtgatatgactcagaagtactagaatgaattttgacttaataactctaaaaataaaaagcattttgttttctctgacaaatagctctcgttcattttgatgctcgacagacagctgatattttataaaactttatgattgcctcttcatcaagcactgtaattgtaggtttgtcttctttgcaagtatggggaactgggtattttcttttaaatacttgtcatcctaggaggcggattgcctatgcctgtcatgcaaatcaacttttcaggcatcataggcagaactaggaaagtagaacaatggaaaaatatatatttttgtctaaaatttatggatctgtgacttgcctgaaagagttatttgagaaggtttttataaactcaaacagatcctttaaactagatatttcccagactgcccaaaaaagggcccctgtcccccaataccacacaacactatgagaaagtagaattttattgcttgggtttttcttttcctcatactttgaaagatctctttggccagctttccattcagtgttaacccacactcgtcagtgtttgatgtcatgagaagaggactctggcttgctcaaggatcatgagtgagtaaatttttcagtcttccagaaggggaaaaggaagcatcattttggtatcttagggattaagacacttgctaacatgatatcaagaaaaaagcttgcacactctccaattggtatactggctccatgccagttacatagttttgggtttttccttgtttttcatgta

SEQ ID NO: 1067 - DNA, 88 bp, Homo sapiens
tataagtctggccacaccagttttaccatctttcactttggtttcttatctagatggtattatctatatggaataggcaagtgggtta

SEQ ID NO: 1068 - DNA, 702 bp, Homo sapiens
ggaggtacttttcagggaaatgatgtttcacaaaactgccacgctgcaggcagaattagaaaataggccttgggaattgcagaaatagggctccaggtccaccagaattatttcctcttttcattccctcttggccctgtaagattggctttatttttctctctcactgtagccagttttcttctggaagagaaaacatggatagtgacagctcttgagccttttagcttatggcttcagctgcttcagaagagatcaaccaaactctattggtcctaactccaaacatccagggaaggaacttcctgcccctgatcctgttaactgtggccagtagtgccatgtaagagcactgaaatttttggaaagaccttagggatgaagtattgttgtcagaggaagaggagggactggtagtaaaaacaataggtgtacattctttgtgggcagtgctggattatatagctaatcatggggcttggatactggagttcattagtgcatcttgtaacaaggccacttttgggggtgtggctcccacatggataattagctggatcctggtcttcagctgtgtcctgctctatccctgactagccatctcacaactgcttgttcctggtcctggggggtacctgcggagagaaagtgtgtgggtggtagatcaacagaaatccctcgccactgctagaaaaacaactc

SEQ ID NO: 1069 - DNA, 227 bp, Homo sapiens
atttatgtagatgatttcttataatgtgggatttccctctccagcaattttcctttgccaactctctgaagcacagttttggtaacattcatatgatgctgcaatcataggataccataaagctctgcagagaggcaactctggttgtcctagagaatgcatttgtcaaatatatgtgcctttgggatatattactagctattagccattatctttcgtagcttttg

SEQ ID NO: 1070 - DNA, 469 bp, Homo sapiens
ataaactgtgaaacaacaataagaaatgtttctttttctttttgttatcacctgggcctgaatgacagagtttttctccatctcttggcatttctcctagctgtgtctgagtgaataatcagggactttctcagaaaagagaaggaaatgcaggaccattggtaggaacttgacctttgtttctatcatactgaggttaagcaaactctttatttctgtattcttcgtctggcatcctttggggaacctcttcttgaggttaaggtgagatgaaggcttcctttggagacacgttcaggccaagcttcatgctctgaggagttgtttcaggaagaaagagagaggagctatgtgtatgttctcccagtgtgaatagggactaatgtgaaacatatgccattgcctttaatcaggctattaagcatttctcagttttgatggaacctctatctgagaggttcacctatag

SEQ ID NO: 1071 - DNA, 679 bp, Homo sapiens
caacatcttcttcttagtgtggtggttttgattgttgagctttcttttggtggagaaggagaaaggatttttaggccatgatttttattctcatcaaaaggcatatattgagaccacttcatacccgctaggatttttctgaaatttaattatgaatgccattttaaattccagaaggggttgccttacttttgttaaatacagtactctttattccctcctagaaatggcacagatctctcttggagagggcaaggtgactctactccccttctcatcctcttaagaaatatcatggcttcttatctgttatatattgtctgtggtcttagaagaaagtctgtgctccagtttggccataaattaactcagagccatatgtattgagcaatataccccaccaagctgtaaaacaaatgaacaaatggaaaacaacaaaagaaactccaaaccaaccaaccaatcagaaacaggtcactgccccatgacagttttgaagtgtgtgtgaaagaggagaaagagctttaagactgtccattctggagggcagcaagatgttgttgcttcaggtagcataagagggaacagattctcttctacaatgccatgtttgtggttcttggaaaagcacagcaaaacctttcaaggcaaactgtttcatcattctgggataacacca

SEQ ID NO: 1072 - DNA, 884 bp, Homo sapiens
gtgggaagacttaaataagtaaagaggaagagggcttcctagtgtggttgtgcaggttgtacataaacaactctaaacagcaccataaatgtcacaatccatgtgtatggccccaagatggaaagacactccaggagggaaaaaaagcatggaaaaaaacaaggagatagagttacataatacatggaaagtttatttggctgatgctagtcaaatatccatctacttatttaggaaatatttatcgtctggcatcattgagatcacactgaacagagtggaagattcatttaggaaagcagtgacaaaaatgtgtgggctgttgctattcaatgtgaggccttgaatgtcaaaccaaggacttaggactttgccccatgggcaatcaggaggtatagaaggttttggatgagaggttgatgttttaaaaatagtgttctagaaggatatcttggcaacaatgtgccagatggcttgggttatggggtgacttgtggtggggaagtgaaggaaaaccataaaccaggaaaagagtggagagtgttaaaggtaattcagtatgggttaacagaaagacatggagtcattttcaaacatacagagtcgactgtacattcaccaattaggtgcttggtaaatgcttactatgtccgtggttctctaatacatgtaaaagggagacagaaaaaaattcaacagtaataatcccaggtatatctgtgaatataaaacacatatccacattgcaagtcagcctgtcaataagggaggacagaacatagataagcagaatgagatatagtgaataaatttaataactgccaactagttagcatttatggagctccttaatggcttaaagcatgactgtatcacacgagttt

SEQ ID NO: 1073 - DNA, 550 bp, Homo sapiens
attgtgctacctagccttgcactgtgccaagctcagtatctctacaatacataggtaggggaacctctagttactgagccagctttgtcagctgtggcgagggtcatacctgatgcagccatgagtgcatcccttcctcaaggggcatacaagaccctgccgagctaagacatccagtatggggtctttgtcactgccaagaatgcccctggccataataactgtccttgagtagcaagaatagcagagtccctactccctgctcctggatgagttaggtcaacagggactccaccaactctccatggcactggtccatcagagctgcctcatgcctatttccatgcctaggttatgctgtaggaagcattggcatatccaaggctagatctttcatttccttcccctgcgagtcttctgtaattgcttggaactctgggaagtccagcttttggcttagtagagggctgttctttcactgagtcagggccctttcatgatggaacctcttctgattatgaaggtaatgttagagtagttggtgggtata

SEQ ID NO: 1074 - DNA, 581 bp, Homo sapiens
tcctggggaagctcttcccactccacatttcattgtcctgttgtccttgctctcctaattctacttcccttccctcaccttttctggaagtctatttgagcctggatccagaagatgcaagggagagatctgaagtgttgcttaaaaaaaccgcgacagcccacttatgcttaggagctttttctgggcacctttcagcagcaacacaccctcacagttggacttcctgtggtgaaggaaattttctaatttcttttattaggctaattaggaaaagaaaaacaatcattttttctcaaatcagatactataactgggacacaatgattattaatcatcatcagctgcaattgaagtccatttggtcattcaacaaacattccccaaccccattcccacctttccaattatgcaacccctcagttaaaatcgccatctccagaaggctctccctaactaatttggcccacaatggtaaaccccttttcaaaatttgtgtaacatttgacatctgtattacttatttggtatgtattatagtgtaccttaaaatctttaatgtacacatatacataacaaaa

SEQ ID NO: 1075 - DNA, 190 bp, Homo sapiens
aaaagttctcaaatgtttgctgaatgattaaatgattaaataatttgaggatgggtattttttgggcccataaatttagaaattactgttaaataacattatatagatttcgtagattacaaattttgaaaaaattgaacagcaataaaatacattttaaattcaaacaatatatgggcataccttggag

SEQ ID NO: 1076 - DNA, 24 bp, Homo sapiens
tagaactaatctcgtgtcttagat

SEQ ID NO: 1077 - DNA, 177 bp, Homo sapiens
caactagatttaccttgcatgcagttttcagtgtatggacatggtttactggagaaagattctgagaccatgtccaaacccatctatgaaaagtacctggaattgttagtcatgtcagcaaatgcagaggaggaagtataggtagtgtaagtatagacgttctctgaggtccctccg

SEQ ID NO: 1078 - DNA, 121 bp, Homo sapiens
tagtgtagagtatgctacttgatctaaattcaggaaaacatgcccagggcgtaggacttccatactacacaaattttcttaattgcattggtgtaaaatgtgcaattaaaagggtaatgag

SEQ ID NO: 1079 - DNA, 92 bp, Homo sapiens
atcctataaaaaagaatgatagatactctagcaagatgaaagaacaaggaagaatttcaaaattcagttcatttcagtgaacatttatccat

SEQ ID NO: 1080 - DNA, 1686 bp, Homo sapiens
caggggttaccagtaactgattcaagaaggagagctgttcacagagcaagatgtttcacagaagggaaagctattgaactaggtcttataggaagagttatcaattgacagaatatgaaaatggggcatcttgggaagaggaaatggtacctgtatctggaaaatgtaatgcattatcaaaggaccgtgaatgtttctgagagggatcctccttaggagtggggggagataaggctcggtaaatggatgaggcccagactgttgtgtcatggtgtctaactagtgggcaaagtagagccactgcagggttctaagcagaggaaggccaccatgagaacagtgtgttgggaacactgatgttggcttcaggagggtcagagggaattcactgggcagcacagtggttcagggtaagggaatgctgtataagcaccaggcttcttcccaggtgttcttaattattacaaattaggaagattaaggtttaaattgtgtcactaacatgcttattcagtgggtgaggctacaggttgctaaacttgttagaattgtgatacaataatctcattgttttagtgtcatgtcttttccacccacctctgctttctctttctaaccgtctcccaccccatgttattggcatttagttcatattcattttagtattaaagggaagtaattatttctgtattgtgaaattggcatttgagatcattggaaatattctttaatgctgtaagctagagttttaaaaaataggattagttaagtcatattttttaaaagcgaaaaaaatcacccagaagctattgaagatgatgagataatgagatgaagaagttgagatggactgtgtgtctcttgagtcaatgtcgataacctttggaacctgtcctaagtgagaacctcgattgccctactgcaaatgcacgtgttcagctgctgattcaggactgatcactgggggtgcctcagaactttccattttcttagattcgtcagcaaactcacactcagggaccttatgagaccaagtcagagtaaatgtccagggtttacagagtggatacagtggctctgtttctcaagaaggactctgtataattaaattatcattcttctattaaaaaattgaaattctttctcccaggagctcattgccagtgccttctctgtagtcttatagtcaattcaaaaatatatcacttctggaagatgtgagcttgaagtgtgaatgctatcacatgaatcttctttttatcatagaaaaggcttttaggtggggtgttgatgtcaagattaactcagagaaaattggctgcagttagggctgaatgatagtgatcattccaaaactcattaggagtctaaaaagtgaatatttagactttgaccaaaacccatttgtcctagagtgaaatatggtagcgagagaaagacagccctgcaaccccgaagtgtaggcgggcctttctttaggaaccaggcatgttcttgaaatcttgtgtgtcaatcagctttttgtaaatggaatccttttttctccttcattaactttccctgtaatttcagcagtgtttaacattcattactgattgatcttgagttggcagttaactgctaacattcagatttggattttagtgcttctttcttgattttcttgcctttttttctttgctcact

SEQ ID NO: 1081 - DNA, 534 bp, Homo sapiens
gtaaacaattaccgtaggaaatggtaaatgcaaatcctaggagtacagagaagctgtggtagcacggagtccctctgtctggggagggcttcccagggcaggggttactgaaggatctgaagatgtgaggaggtgcttgcttgggtgatgcccatccaaggaagaccaggatcagaggcaggtttgggattaactaactggaaggactttggtgttgaggagtttcagtctcaggacaagcagtgaagcagctgatgctctttgcttagccttctacatggagtgagttgtggggaaaagttgtttgcaacatgtatttttctaatggccagggaggggttatttcactattatttctctccaacttttctatcaaatacacttgtggagtttctgtagtgtgaattgtcttacttcaatctgtaagttcaatctatattcatgaagtaggagggcacccctaaataagattgagagggaaaaaacatgaatattttcagttttagtgggaactctcatatttgacttagtaac

SEQ ID NO: 1082 - DNA, 62 bp, Homo sapiens
ggtaaaggacaccataagtaatgtcaacaaatgattaatacactgagaaaaatgacacgtga

SEQ ID NO: 1083 - DNA, 115 bp, Homo sapiens
gagtaggaagattagtggaatgttgcctacctgtggttctgtgcgtctgtgtgggtctactttaatgagtttagatctaggtgcttgtcctggaggcacattcacagtgtgtttt

SEQ ID NO: 1084 - DNA, 2295 bp, Homo sapiens
tagcaaaatgctatgtgtaagtttgaatgtgcatgaagataggtgggaagaaaacacatcgggccataagcacttaccacagcaggatgggaatggggggagggtgggggcaagtaactttttctatatacatctttgtatgcagttgtatacatattgcctttgtaatttaatgtacaaagacaaaataagtacctagaaattaagaacagattagtacactttttctgctactgtcttgccatagtgttgttcaaaccagctagaaaacaattctgtggtgccaggtgagatgaactctccacctcttcctgagggctttgtcttcatgcatgggacaaagcagtgtaattaacatgcccccccaccccgccttaaaacctaatattcattcatctcttactttggttattatttaaaaagaaaacatttgtcaattacttcacactgacaagcaccatcccactgagggggcaggcaggaggtccatctcaccacccagctgtattgcaacaacgccctctccatctgggaatacggcccaggcactcctctggaatcctgaacacactccaggcacctctcttcttactgaacaccacctatgcttggagcaccatgtgagaggacacctctggtatcaggcagcttcagatgtattcagagagattgaaaactgcaaggattcaaggcataacaaatgatacacagacaagaaaaaaagacatttagagtgggggatagggcctgaaggcttgaatggtcctacaagactttctcaaaagtcgtcaccctgggacctgaaacattagagctctttccagagtaagtctattctcagccagaggtctccaacagaggctgtccatgtgtactggtttcaagttctgcttacctcccaagtgttgttttttctgaccctgacctaattcctcccaggccaggctggccagcaccttctgaaattgctctcaggcagctggaaggcctggctggcaggagccctgggtttttcaccctcagccccagggctctttgaaggcctactctccaagaacaaacaaacctggcctgacgctgcatagctgcagaataggggagctttctcggcctggtgcccagggtggccgagctgccagccaggtgcatgatcctcagttaattaggtaactataggtagtcctgcagcccaggctgtgtgctgattagtctgggctgttgttggagacctctgagaatagacttactctggaaagagctctgatgtttcaggtccagggtgatgacttttgagaaagtcttgtaggaccattcaaaccttcaggctctatccccctctctaaatgtcttttttcttgcctgtatatcatctgctatgccttgaatccttgcagttttcagtctctctgaatatatcttaagttgcctgataccagaggtgtcctctcacagtgtgctcccccagcatcgtgctctgagcataggtggtgttcagcaagaagagaggtgcctggagtgtgttcaggattccagaggagtgcctgggccgtattcccagaaggagagggcgttgttgcagtatggctgggtggtgagataggcctcctgcctgccccctcagtgggatggtgcttgtcagtgtgaagtaaaccctggagcacctgagggaggaagaggaggagatagatcttcagcttccagggattagactgaaagctcaactggcaaaatgcccattttattccctcattgcaagctgaaagtagagagctgaggaaccccgggcttgaccacttttttgcattgacagatcctttgtgggagacacatgatccacatgggcattcctagatccctttgaagactccataagcccagggagatcagatttacctcaggtttcaagtagatctcaagatcccactggaactcagattttcaggggagttcagaattagggcacgaagtgcaggagatggtatcaacagcaacaaatctgtctgatattctaaaagagttcatcccagtgtagccccaaagacttcagactgaaccagattcaccttgaattgaataagctgatgcaatattggcagctacacattcttcatatgacacctcttttctcaacttctcttcaccctgtagtctccacagagatattcctgagggatagcaagagtggggagctaacctgtttctttgcactgaatgagcaatgcttgtgcctttcctcttttcttgtatccgtacatttccagaggagccagtttatagagggtatagagtaaccca

SEQ ID NO: 1085 - DNA, 133 bp, Homo sapiens
tggggtgggagcaggtgttgaaaggagcctgctgctggggattggctggcccccaaggagcttatgcccctcttgctaggatgctggggatcaggtcagtaacacctgtatttacagatgtgggctttgttac

SEQ ID NO: 1086 - DNA, 229 bp, Homo sapiens
gacagtcatagcccatatataacccacttcctgatgtgatttgtttggcccagttttacaaagttgtcctgtcagaggaatttcatttataaagttccttattgctgagcctctgtgtgttccagttatgagtcacatgtgtcaacaccgtggaaatgaaatttgtaccccctggacccatgcagattgatttgattctgggctaaatggaaatagaacctgtacaagt

SEQ ID NO: 1087 - DNA, 119 bp, Homo sapiens
ccaacaatgttttaaagcttccagtagtttcctaaaaaataccatagtctttttgagtttggagaatattattactgttgtcaattactttttattagcaccctgtatgatataggtac

SEQ ID NO: 1088 - DNA, 390 bp, Homo sapiens
tgcaaaaaagccaaagttcaacagaggaaaggctgactcgcaccaccagaactggatgtcccttcagaggtgtctctaatcgaggcaaggggcagtttccaaggaagggtgcagcagctggggaataagagtgtctgccctgaaagcagaacctgagtataatatcatggtatccactccaggcattcaaattcattcttatcaccatagctaatacttaccgaatgctttctgcttgccatagcttgagcgagtgttttagctgcactgtttccgattcatgcaatgtagagatgaggcagttaaggggcagagaagtgaactgcacaatgaataccatggtaggcagagaggtggagaggggaattattaataactgtcagactacac

SEQ ID NO: 1089 - DNA, 158 bp, Homo sapiens
ttcctattagcctatgatgtctcacagagataacctgtccaggtagatacccagttttggctggagaaggcatcacagaccttgggtaattgatggcccaccagtttgcacccctttccattaatgtggaccgatcatgccctttgttgtgggtcagt

SEQ ID NO: 1090 - DNA, 1288 bp, Homo sapiens
ttctcccctccctggcaaaagggttcaaggctgcacaaagattatctaagggcagatactctgaacatagccatagtttattgattcagcgttttgtcatttgcttccctctctcaagaggcaagagagaaagcgagactgtcttccatgcagtttgctcagaattctaacactagcctgttagtctaatcataacacatttcttcttggaaacaaacatagcaacagcaattatatcttacttttaatgtctaattggctgtaaacttgcttttactaagttatttccatcgaacatgtagagcattgtgcagtttgcttatcttgatgtcctcctcttgcagtccccatcttggctttattcgggaggccaattatgtgtatgctagccttgtgggtgccctagaaactccagcaaaggccagtgacagtgttgtgagccttctgcccctcattatccacagaggcaggagcctatcagagcctccaaccttgaatttttgtgtgagttctgcttctgttctcctactccaggtatgtcccctcacctggcttctggagtaacccatccctgctctctgaacccccacttcgctgtgccttcctctgcttctaaccctgcctctacgatgggctctctctccttttcctcataagccgatcattcttttcctgcaagaagtcccacagggaagccatgccatcctagccagacttggttatggtatgacctggcgttcagaggacacaccccagcacctctacactggctttcagccagatatgtcttcaccgcttgttgagacagaacagctttcttctacctttatgctatgaagcagcctttccaggagccctactggggccagagcccaagtgggaagatcctcccttaagctttcccctctgtttttccaactcctgaaacttacatccttctgcaggcttcaggactcagtgtaggtgtgtctgatgcccggtcatcctagagaaggggttgtgggaggggctgtacctgttgctatggcagcaaccagttgagatcatgaacccatttgattcagaggcaattgcaaggtgaatcaatctccttgtcacccactcctcttctcctccctctccatctctccccacagccttctgtcatctttcctcctccccactcaacctcaagctttctccttccccagttctctctctctctctttttttactcctagttatgatacatcaatgtagcagctaaagctactcatggtagacttcttatttatattatactttagca

SEQ ID NO: 1091 - DNA, 87 bp, Homo sapiens
cgctagactatgtttacccagtttgatttggttgtggctggaatattcctctgcattttgattctaaagtatttgattagctcattc

SEQ ID NO: 1092 - DNA, 227 bp, Homo sapiens
aacctgcaaataataagagatttaaaagtatacaaccaactccttgctcatggcaagtaaaatatttagatgataggaatataaataataatgacctattcatttatttttctttctttgccaagaattgcctgaagggaactgagcttaacctatttaaataataatattaacatctaatgtttgtggagcatttactatgtttcagatactgtaccacatacaag

SEQ ID NO: 1093 - DNA, 966 bp, Homo sapiens
accaacatattttgacctgaggctgaatatcacagaattggcctagagaaattgatatcttccagactaaataaatctccaggattttgtcaagagaatggatgggggctggacctcaatgtggggattagagaattccaaaacaggcctgaaaactccttggagcaccagtcagaggaagcagccctacttggctgtcggagaatcagtgcaccccaatggaatataagaaaggccctgatggatggccaggatttggaccatgaaacttgttttggaggagggagggggattgtcaggactgaggctttacagtctctggttgacacagctgaggaaggcagaaccctcaggctggggtgtgagagtttcaagcttagccttgaccagtctttccatctagagaaccagggtcactttcaggcccaaatgccacggggctggtgctgtcagcattatcagagcgtttcctagcaatgcccatcagcaaagaggctgtgttttctgaaccttctccaaagaggctgccctctcccctcttcaatatgcacccccatccctgagagaagtgatttcctcttgttatttggaaatcagggagagagtttcccaatctttgtctggggctctacagggaccacagtccacattcatgttgagtcaggtctctcttttctgtctcttagacccagcttcacagctgagactgtagctatatgagaaagcagaatctaccagttttgttttaatcctttcctgagctcatcagagataagagtgatagaaactttcttcttacagagaggattagaagttctttgtggcaagatatacctgggaaggggttattaagtgatcatccctgataaagcccctctaatcatctactagttttgctattttagtggtgggaaaaaaaacacaaaaccctaggcacttaactcactcttggggaaatctttctaa

SEQ ID NO: 1094 - DNA, 91 bp, Homo sapiens
ttctgtgtgtctttgtgtctttctgtctttcatcctttctgcttgtctcagatttaatcggagccatacattccgcttattcacttatttg

SEQ ID NO: 1095 - DNA, 115 bp, Homo sapiens
ttcttgttcttgagggtgtcaaatattgtagaagtgaacaacataccagcccacaatgattatgttgcagttaagtggtatggtggaattcagtgtagggcataagggagtgact

SEQ ID NO: 1096 - DNA, 585 bp, Homo sapiens
gtaggggattggcatgggcaaattcccatttcaaggtattaagcaggggagagacagggcaagatgtgttggttagaaatgacaactcttccctgctctgaagaatgaaaccagctgtgcctgggaatcacttgccccactttacaagatctccctggcaacagaatggctgttgtacaactagccagggaatttgctgtgacagtcttccaaccttatctgacatccagagcagggaaggaattgccaagttagggtatagatatcaaaggaattgaagcaacacaacattggaatagtattacaatatgaaattagaaactattttctctgctggcattgttgtaaataccagcatccatcactcccttctcaaatatattgtaagttaaaacattgctatttttatctctaacccccttgccctctaacccaggcaatacaatatagcttcttgaggagaggcccaagctgggtgtggattccgaatcttcacccagcttcacatgcttattgtgggagcttgggcacatcccctgtgccttctgagcctgggttgtgttgttattgttgcttgttggtttg

SEQ ID NO: 1097 - DNA, 107 bp, Homo sapiens
gtttgttacatgtacaattgcaatagcacctctcttgcatgtggttgtgaagattaatgtatgctatgcacctggtccaatgtccagcttagagtagagtagatgcc

SEQ ID NO: 1098 - DNA, 568 bp, Homo sapiens
gagtagatgcttaacaagtggaaaccattattatttttctccccttcgatacatggagccttagggtctaagtgacaggaaaatgttcagataaagatgttttaattatgtcttcttagtacttccagaaagaggtctgcatgggtttaggtcagctctgccttccgacagcttacgtgcattcttgtgttgctctcccatcttcactgctcttcctacattccaccctaatgaacggcagagagagctatgcaaagtggtcaaagtaaaaagggattctttccgatgtttcccagattggagaaacaatgaacatgattactttattatctctgttttgttttaatcttgttgtgccccaaactaatggggatgctcatttggaatgagctttgtgtatctttgggcaaagaggaaaaccaagatgaatttctaggagggcagcaggagagtgaataagagagtacaaatcatcacaaatcaagagatgagtaaagagaagggggttgggaatggcagaattggaacctgagagttagagtccatgagagagaggagaagcaaaatg

SEQ ID NO: 1099 - DNA, 24 bp, Homo sapiens
tgcctgacacagtgatttctataa

SEQ ID NO: 1100 - DNA, 128 bp, Homo sapiens
gtgtgctatgagaaactgacctcatagggccatcttggagtgactcacccatgtaccttcaggccttcaggtgattaataggcatgtaggactgacgtttcattatcactgcatcaacgctgatgtag

SEQ ID NO: 1101 - DNA, 1282 bp, Homo sapiens
cctgtttttgttaaggaataggagtgtttcctgtggccacagaataaacgaaactaactgtcctggggcttcttcaggaaaccagtggggctaaccagacttacatagtgtttgatacacaatcattaattaaaacagagatgttcaatgataaattaattcgccttctgctcagaattcattgaggagggaagaatggaagccaagaaaaatgattatctgaagcttttttcttgagcgtctgcccttgtaggctgtgctgaatatttgagtgagctaagtgtacttgctgtatgtcaacagagatgacattttacaggtgatatatttatttccagagaaggaaacttatataggcttgtgaagcagaagaatgccagcaggtttctaatctcctattagtaaacaacattatcgagaatctcctgtttgtggagtaatattctaggcatttgtagagtgaacacagaaataaagatgcagttctgtctttaagaaacattcagccctaatgggaatggaggaccaatatgtaaaagagacagaacacatataaagaaggtccataaataagtgcaaataaatgcctgagtgcagcacttaatgttctgttttctattataggtatttgtactcacgacttagccttcttatggataccaaagcccttgagaactgttttcctttctcattcatcttgtgcagagtacacactcaaaagtgttgaatgaatatgtatgctactgtgaggtgtgcctaattgctgggggaattctggagtgaagtagaatgacatgtttaggggaaaccttatagcggcttagcagtgttttcaagtatgagaggacttgtaattggtggagtaaggggacaggagggagaagaaagaaggaagagttcacggggactgagcaaatccaaacaatttatgccaccattcagggtcctccatgatctgatccttcaggtcttaccttgccttgcttgctgccaccaaaggcagcccactgtggccttagcattcccacctctttctctctccttggaatgtcttcctctgttgattggccatctgaatccaccttccacttcatgtctgggtgaaagtagagtctcaggaagccttacatgacatctctatccttgctcctatcttcattaaatggcagtgtttgcaggtctgatttcagtggtcttaaccttcagaggaaacgagagacaatcatggtcttcaacctcgggtagctttcaaatgagatcatgaggcaacactaattttttg

SEQ ID NO: 1102 - DNA, 80 bp, Homo sapiens
tggggcaacactaattatatacaaaataataagagggagcagggctgtatataattaggtgctaaacagagtagacagaa

SEQ ID NO: 1103 - DNA, 696 bp, Homo sapiens
agaatctgcaagatgataaaggttagagtactcatattagactgagtgggaaatagtgatttgttagtaagaggggagaggggaacatcaggaaaagcaataaatgatggcgaccagaaggactgattcctgacaaccataggacaaagtggagaatcagagagggactggttgaagagcggttaccttggtattatccagcatgttctttctggaataggatgggcactgcacaaaacgttcacaatagaggatatatgaagcctcctgtactcttttgcgtttctgatactcacctcccctcttgttttcagagccctttctggtgcttgccactctttaaagaatacaaatctctcatcagcaagccctgtagaaggggcaaaggggtgatgcactttagctcatcaccactgggcacgttctctttaatcctctcttaaattcacctgctttggctgatctgcatacagtgggagtggtgtcagatcaacacactggccttttcccaaagcaaagcgggatcccagcctggatggcccagcacagggtcagctgcctccatcctggccccccagagcatctgcctccccagcaccctgggctgcagttgcagagggccttctttttaatgtttttctaataatcatttttttcaaaccctaaaacaacactttgttattgcatgatagttgc

SEQ ID NO: 1104 - DNA, 468 bp, Homo sapiens
gaataactcatttctaccccctcactccccccacaggttatcatcactattattaataacatttttcactgttttgactaaaaaaggttttcttttaaaattcacccatgacccagaactatttaaataaactaattttattttggagaaagaccctaaaacttttattatagagattttcagtcatgcacaaaagtagagagaataaaatattaaaccctatgtaacccacatcagccccagcagttacaagaagaccttaaagtctttagaggatccggcatctccctgttgggcttctgtgtcagagttcagaaagggagaggggagggacaggataaatatcacatgacatcaatgttggaattactaggatttaagcagagggattttaagcacagcaggaccctgagccctgcccatattggaggtgcccacttttgcagaccctgccacggcagccttcgt

SEQ ID NO: 1105 - DNA, 131 bp, Homo sapiens; identical to SEQ ID NO: 132

SEQ ID NO: 1106 - DNA, 96 bp, Homo sapiens; identical to SEQ ID NO: 133

SEQ ID NO: 1107 - DNA, 61 bp, Homo sapiens; identical to SEQ ID NO: 134

SEQ ID NO: 1108 - DNA, 38 bp, Homo sapiens; identical to SEQ ID NO: 135

SEQ ID NO: 1109 - DNA, 549 bp, Homo sapiens; identical to SEQ ID NO: 136

SEQ ID NO: 1110 - DNA, 512 bp, Homo sapiens; identical to SEQ ID NO: 137

SEQ ID NO: 1111 - DNA, 300 bp, Homo sapiens; identical to SEQ ID NO: 138

SEQ ID NO: 1112 - DNA, 117 bp, Homo sapiens; identical to SEQ ID NO: 139

SEQ ID NO: 1113 - DNA, 82 bp, Homo sapiens; identical to SEQ ID NO: 140

SEQ ID NO: 1114 - DNA, 887 bp, Homo sapiens; identical to SEQ ID NO: 141

SEQ ID NO: 1115 - DNA, 87 bp, Homo sapiens; identical to SEQ ID NO: 142

SEQ ID NO: 1116 - DNA, 23 bp, Homo sapiens
aactatgacctaaagaaattagt

SEQ ID NO: 1117 - DNA, 309 bp, Homo sapiens; identical to SEQ ID NO: 144

SEQ ID NO: 1118 - DNA, 116 bp, Homo sapiens; identical to SEQ ID NO: 145

SEQ ID NO: 1119 - DNA, 37 bp, Homo sapiens; identical to SEQ ID NO: 146

SEQ ID NO: 1120 - DNA, 116 bp, Homo sapiens; identical to SEQ ID NO: 147

SEQ ID NO: 1121 - DNA, 342 bp, Homo sapiens; identical to SEQ ID NO: 148

SEQ ID NO: 1122 - DNA, 708 bp, Homo sapiens; identical to SEQ ID NO: 149

SEQ ID NO: 1123 - DNA, 102 bp, Homo sapiens; identical to SEQ ID NO: 150

SEQ ID NO: 1124 - DNA, 133 bp, Homo sapiens; identical to SEQ ID NO: 151

SEQ ID NO: 1125 - DNA, 20 bp, Homo sapiens
ttagtaaatcaataacataa

SEQ ID NO: 1126 - DNA, 323 bp, Homo sapiens; identical to SEQ ID NO: 153

SEQ ID NO: 1127 - DNA, 227 bp, Homo sapiens; identical to SEQ ID NO: 154

SEQ ID NO: 1128 - DNA, 21 bp, Homo sapiens
tggcaatgtgatccataacct

SEQ ID NO: 1129 - DNA, 129 bp, Homo sapiens; identical to SEQ ID NO: 156

SEQ ID NO: 1130 - DNA, 111 bp, Homo sapiens; identical to SEQ ID NO: 157

SEQ ID NO: 1131 - DNA, 130 bp, Homo sapiens; identical to SEQ ID NO: 158

SEQ ID NO: 1132 - DNA, 154 bp, Homo sapiens; identical to SEQ ID NO: 159

SEQ ID NO: 1133 - DNA, 419 bp, Homo sapiens; identical to SEQ ID NO: 160

SEQ ID NO: 1134 - DNA, 607 bp, Homo sapiens; identical to SEQ ID NO: 161

SEQ ID NO: 1135 - DNA, 180 bp, Homo sapiens
ttggtatggagaagttcgaatcccctggatccacctggtggatttcccagtgctcacgaacatgttctttatgccacaaaatgtcaaaattaaaccctgcagagcagataattatgaaacatggaaaaggatgcatttgtagactcatttctgttttcctaaaaataccccttccactta

SEQ ID NO: 1136 - DNA, 148 bp, Homo sapiens
tgtttcaaatatggcccatctctgtcctccaccttgagggttctttgtttggaaggccacactcctgggagaaaaggagtcttggaagtactgacagagataaacaatacttcttgagtttgtattacatgttagactgtttttaaaa

SEQ ID NO: 1137 - DNA, 351 bp, Homo sapiens
gctagaccccagggccctgccttagcagtagagcatgaattcatccactcagagtgaagggagagaggttgaccaatctggtaaacacttgaaataatgagaatgaaggggatgagtgaagggtgagatggggagggtgagagacctagccagtaatggttaaaaatcttgtggggcagcagcattggagagcagggatttgtaggagcaccaatctgcacatttgggtgatttttgtttttcatcagtgacctatacatattgagacaaagaagataagcaactaggcttctccagaccagtacatagccagatggtgtacatctcaacaaaaatggggcttttatacta

SEQ ID NO: 1138 - DNA, 54 bp, Homo sapiens
taattgtttcttaccttatagtgcggcgtacatagagcttaacagaaagccttg

SEQ ID NO: 1139 - DNA, 1945 bp, Homo sapiens
ccttggaagtgagagaggaaagaaagcaaaaagtatatgggaggcaaaaagtatacgaaaagcaaaaagtatatgggatagggtggccaggaggggaacgggcaccaagaaggcttgcattatcagcgttcgaggcatggagtgtcgggtgttcaccctacagatcccacaggactcgggcacaggcactccctggctagttaggctgaggtttgggggtgttggtgtgtgatcttcagaggctgaggtgggcggggactgactagggccaaatgagtttctctccccttattttcaatgtgtgttctttccacaagttgcaaggtgggtgaggaggaagcacagaagttgtgtggggtagaaaaagcctggggaaaatggtgcctttaggccacccatcacgtgcctcaagttccaaagaatgtgaacagcaggaaaagagatttgccctctccccactgtcatacatgtgacagtagaaagctgaagatttgagccagaaactggtaagtacaccctggtctctcaataaagtatggcacaggactttttcttggtcctccccgagcctggtctgatacccaggaatttatatcagcagggtgggtggtgtggttcaagttttggcctcagcacaggagttctggtggctgtttaaacagaaagcagccagggtatttttgcttgtgataaatgacagccttacctgctattcttttcatttcttttctttttttatctgttccataggttgatttttttttctgttccacaggtcacctttttattttacctgaaggtaaaacctgacccaattcatcaatattctctcaagcttccttgaccaggagcccaggcaggtttgagtgcagcatttctccaagtgtggtctgaggaccacccacaagagagaggccctgcccaggtgctacgtgtttatcaagttccccagcacactctcaggcacattctactttgggaacctctgttggaatgtcctgccccctctcgttgcttcttaattaatttctctttatttcctccatgacctttagtcatttacttaccaaagcccctgagaatgtaagcccaggctaagtgctggggatgccacagcaaaccacataggcacaggccagccttctcagtttagggcttctggtatttggggaggggaaggggaatagtagaaaggttgggagactaaacaagcaatcataataaagcatgaagagcattacaataaactgtggcaagaataatatcagaatttgttaatgtgactcaggaggccactaaagagagggaaaagtgtgacacccccacctttatggttcagctgcagatggcaccccctgggtcctagtatatacatgtaggagcccatacagccttccagagaaaggtgaagatgagagacagactgagctctactcatgggatacaaggagggatgaaacagtgtatagaggggctctataccatccatggcgtggggagttaaggacaaaagtctggaatgatttatgtttcaatgtcagtggaagatgccaaactttcccaatatctgtgacctcacccagagtaacaagcagtaaaagccagaaagtaaaaatgagggtgggcttgtatacagcctagcagaaaagcgggtgtagggagatctgcaaaccatgctgcagacagcagctagcctggtggaaaggacagacagtgagtgaaagttctatagtgagaaataagggtgcatggggagccagcttcaggaggaaaaaaagacccaagcagcagacgtgatgtggccctaggcacgtccacactcaattttccccactgccttccacatagtcagaccttcccttacaacttggtactctatctcttcctataggcagattcagttctttttattttgaatttcttttaaagtttcatttcatccggc

SEQ ID NO: 1140 - DNA, 1054 bp, Homo sapiens
tttcctaggcattcagtcaatttgtttcctgttccttcctgttttaatttttttttctattttaacagctgcactacaatttatttctattcttgaatgctgtcttaacttttttggaagtttatgcagatataaattatgatgaaatgaaacacgtgtgtccattttctcccacccaccaatcctttacccctccctgactgcagtcatattgccatggagtcacctcttcttatggtctttccccaatctccataataatcttttgttactattcactacaggcacaaacacacctgccagacctccccattctcttcatttttctccttgatttccacctactggccttgcttgtggctcccacctctgtcctgaccctaacatttagtgttcattgttcttccctaattctgatgcatcccctgtctcccagatgttggctaacataacacccattcccctagagaagaattagtgtcaactgtctttccacaacagattcccctagggaaattgagcattcagttatgagggaccaaaatgggacttagttcagagattcttacaccctgcccccaaatcctgagcaatgaaataaacttaaccaaggtcttcttttgtgcatttctgtcctgctgcttggtaaatgtgtgctcactcattcataatgaaggcttatcagcccagcattgctcatcctgctgtttgacagttgtgcctcctaaaccctttgaatcttaaattagcgtcacagcaatgttatgattcattgctctcactctttctcgaggttgtggttgtttcttttaaacagctcttccattaaggtgaaagagccaacacagaacacacacatatatcttccccagtccccagctctgtgggtggtccagcaatttagttccaaatatagcctctgagaaggggaaagcatgcttgtttgtctgctcttgaaacttaattttcaatggaagtcagtactggtaaaagatagtttaaaatttttgaggggggtatagctgtttgtgttccacactatctgagttctacc

SEQ ID NO: 1141 - DNA, 60 bp, Homo sapiens
cacagtcttaaagatgaactttagctttgcccaatttggctaatacagaggatgaatatc

SEQ ID NO: 1142 - DNA, 118 bp, Homo sapiens
tattccaaaaatgcatttcttttctaaaataaggaggaaaatttaaaatagagaatggatctagggacaagattttacccatcattatttaagagcttaatgatgtaggattgtctcc

SEQ ID NO: 1143 - DNA, 321 bp, Homo sapiens
tctcctcttctcttgtcaaaaggaagatgtttttgtccttttgtgatgattactttgtatgtctgagtatataactcacctctttagtggtttatggccctctcacagtcatggggctgtgcagctacctagctttattagtcctaactaccagctttaaattgtggatgctgtcatgccataggcatattcttatatgaatatataagaatatatacatgcctgaagcgtgttgtaagtagcatgttttccttaacaaaatccattttcataaataaaaacactctacacatacatatcccaattttctttttatccttt

SEQ ID NO: 1144 - DNA, 29 bp, Homo sapiens
tactgagtcttgtataaatgctaatggag

SEQ ID NO: 1145 - DNA, 202 bp, Homo sapiens
caggggaaactcatatcttattctcttataattatttttaagatacatgactctacaaatcacaaccttagtgatcaccaatgacctacagttgccaatccagtgggaatctttattctacttgatttctacttagccctgaggaccatttcctgctttactccagttgcctttctcagttcctgttgttatatattatctt

SEQ ID NO: 1146 - DNA, 64 bp, Homo sapiens
aattctgggacctgaaattctatatgttcaagtcaaacacatgatcactgtagttactagcgtc

SEQ ID NO: 1147 - DNA, 126 bp, Homo sapiens
acccactgcccccaaaaaaccctcatcaactccattatttctattaaacaagataatgcgtgtaaaacattatgtaaatgtaacagtactcctctatgttattaattctactggtataattttttt

SEQ ID NO: 1148 - DNA, 42 bp, Homo sapiens
tctactggtataattttaataatattgaaagtttaaataaaa

SEQ ID NO: 1149 - DNA, 1295 bp, Homo sapiens
ctttccaatccagattaactttttttgaagcacagtgctgatcatattttggctcataaaccttccatactctccactgcctaaggacaaatagccaatcatatcagccagttagttctcaaagtccaggaactagatccaacttagcttgccagatgtgctctccaccattccacttagcatgccctctgcctgtagccaacaggaactactcactgtctgtaaattactccatctctgaaactgtctctggctgtttcctagagatgaaatgcatcactccccacttttctgtcagcattctcatcacattttggacccacttttaggatccctgtggatatttcagaaaggtatagtgacatagtaatttaagattatttcaaatggaccaaaatcctggatcaaacagacattttctgttaatctaggatggtagattctggtcttggaagattcttttatatatgagaatatgttatttacccacaaagggctttggtaaacaataaataatctagtgtgctggtaactcgaatgtactgataaggccgcctttctgagaaaagaaggcaaatatggtgagtacctgctgtttgccatctgctgtttgccaactgacacaggaagtgtaagtgttcagctttgaggaaagacggctaacggatacatgtttacttttaatgtgtatttatttggctttctttgtgtgctgagtcttcattctcactaaaactgaatacttcagggaaatggaggcagctccatggctgtgttctccagctgccagttttgtctttattctcggaaatcctaacacttcatatctttcagtctcattcgtaccaatttatgctttgctaaatagccattaagcacttttttatcttctctggctgactgaggcaggggacataatccttttgatgttctgaacatagtaattattcagtaaacatttgttgaagtgcgagtaggaactccagaatctatgtcaagggatcttggtgggttaaaaaaaaaagtgtgctttacaaacattctaccctttcacagatttttttcatattaaataatagaaattttcagacataaccaagagttagttgtatttatttgttcatttttcaccaaaagaaggcattttattctcttttggcaacttcaattagctttgcagaaaagaactcaaaataatacaattagtattaccaccttgtacagcaattgcaacaacaccaaaatttcctctgcatttcaaaaaaaagcttttggatgtgaaaacttaacattcc

SEQ ID NO: 1150 - DNA, 1350 bp, Homo sapiens
ttacctgactaaatatcctttaacagcattaacagcattaacagcagagaaattcaattaataaactgcctgcctctttcatttgcaggctatcaagattgattcaggttgattcccagggttctgttttatttccacccaggaaacaccagcattcttgaatcctttcagcattaggcaaaggagcagatgtgggcattctgcatctcaaggaggtctttagcaacacctgctgccttgctggtccctaaagaagtcttgtctgtggtccccatcacctaaagggagctggtgattgtggttgaagacatcctgggtaaaggaacattgtggatcattgcacatacatgtaagttggttcagaaagttcagaaactactcagggatttggagagaacttccaaagctagctttggattttcacatttttatgttcatattgttcacaaataatttttaactgtgagccctgtaccattatggactcaaatttctgagaaagcctcaggaattctatgtactggtgtctcttttaaggctaggaacacaagcagaaactcactccaaatttgaattttaatatgtgctctgcactcaatttaaatgctttaaggaggcacttcctgaagtttgctctatagctcctcagttccaaggggtggtcactggtgaatataatttgagaaatgtcttaagacatactggtttgtttaatgaacagtttctggaaaaaggacataattttgaactctaaatgttgtatctgccacaaataactggctgccaagaatgccactgtgtgcaaattacagagattataataagcagatggattctaggttccggggaggaaaattcatctgaatttaagaggtaagtggagctaaagattctaattggacagaaagtcacatggtttatatggctgacataaaaacacaccctgataatttttagggctctcttctttctgctcttctgccaatgtggatatcatttagtttcatctagacacctgggcagaggccacatagaacctgaagctagctaacgcaaccatatctgatctcccacatcttgcaatcatctttgtccccttgacttttagccatattctactttgcagttcttctctttaccactgaccttacaactgggctcttccttttcaaagtgctctctaaaactagaattctatgattatctgtatgttctacactctgaacttcctcttacaactgtacctctcctcttacccagctggcctatgggaattcattatacatcatgagactctgtggggaaccctgtgattcttctacaacccggggcgtgtagggctgaaaaagt

SEQ ID NO: 1151 - DNA, 73 bp, Homo sapiens
gttggggaaggggagattaggttctgcgttggtctttttccctattgatatctccagatcatttctctacaat

SEQ ID NO: 1152 - DNA, 746 bp, Homo sapiens
ctctgcaatcttttgtaaactacttccttagaagctcatgccattcagttaaatctcttatgttttatcttgcctttgtcacttatctatatcctggtcacccttcaatacacattgaggatgaattacccactggaagacatatccaagaacgtagaaacagtctcttgagttccagataagcaaaagtctaatcctacagagtaacagtaacatcataaagagaaaatgtatttttgttcatgtagcgcctttctataaaaagttcctgattcagaaatgcacttttctcatttgagaaattcacctggaaatacccaggtattgccctaaatggccacagtttttctattccaaagtatctgccagatttagtgttgtaacagggtataaggcatcagaaactttccataaaaagactagagactggctaaaaacaaattttcaggactatagcggaaaatttttagttaatcatctcatcttttttgatgatgtggagctagttgcatgattctggttctgaatggagtccctaatatgggccctggcctcaggcccagataaacctctcttctgagagcctcagaggttccttgtgttgttcaaatgacagctggaagtgaaggttatttttaatttcactgtcaccaccagtaggctcatctctacctaccactgaaagaaagaaaatgaaaaggtaataaatggttaggaaaagagactttcctttttttcttctttta

SEQ ID NO: 1153 - DNA, 681 bp, Homo sapiens
acagggtcttgctatgtttcccaggctcatctcctggccacaagtgagtctccctacgtgctgagttacaagcatgagccaccttagccaagacattttgtatattagttcaatatctcagtaactaaatgatggtttttcctatagacaggagataaattgtgtctgagggtcaagtgtcatatgagtgagactgagatggtcttgaaggcagaaataatggaatatatgatgtgactattttgcagacacaagaggcatacttccagtgtttaagttttagaagtttacctttatttgttcaacccttgagggactgaggacctgtatttcgtgaagttaagaacagccattgcagttcaagaagaaaagcccatgccttcaagacctgtaggaattttgtaacattctgagtgctaaattgaacttgaaaaaatgaactgcaagctctatcacacagccacgtctaaattaatgtaggagagatgggagagactctaaaattgaaagagacaaggaaatgattaatggtagaggaaagaataaatgaaatcagataaaagagaccttcacacacttaagaaaattatcttcatcacaaacaatcaatgccttggggatctatggaacagcatgcttcaatgggctgtatttcaaattctctgagactttatgcattac

SEQ ID NO: 1154 - DNA, 122 bp, Homo sapiens
atattcttattccagggtgaaaaagaaattcatatctttaaaattaacaaaaaagccataaattttcaaatttgctgttgacatgggaagactatcactttgaaggttgatacttttggtgc

SEQ ID NO: 1155 - DNA, 38 bp, Homo sapiens
gacaaggaatgtatcctgatatatactgatttgggctg

SEQ ID NO: 1156 - DNA, 673 bp, Homo sapiens
ggttggcaaacaattaaaagattgacaccccatatctgatcacaatttttcagaggagttcattttacaatttgtgcaatctcaacattggtcgagaagataaggaaagacatgggaaacaaggctaattttgctctgctcaaagctgattagaatgatgagtttagctgcctttatcagaactgtcactctgataagcatgatattgaaggttttgtgacagttatgataataggtggaaggtattgcctgactcactttacttcaacaaagtagaatatatgtatatatgtaaataaaatattagaataaaaggggagaagtaccatgaaaagcatataaataaattagaaactattcagcacaaggaacaaaaagacaagaaacatgttaactttgaatattcattattgtgaattattataaggggagatgaatgaatatccttcctgaacataaggtaactccaactgaagcataagaagttaaaagtagtaaaggaaaatgcttacctaaagagggttactctgctccatagaattccctttgaagttttaggatcaattttactaatgaacaatgagttaggaataagcctgtctgaagacagagttggaagcagagacttcaagagccctcccagccctcatttcagggttgtatttcatcagcc

SEQ ID NO: 1157 - DNA, 175 bp, Homo sapiens
gtttaggcaggagttgataagggcttaaactaagctgtaaaggaagagtcaatgcaagaaatattaatgacttaaaattgggaagattgttaattgttatattgaagcttcaaggaaaagaaggaaactggaatggtcccaggcttctgatttgggtaaccttgtaacttgcctt

SEQ ID NO: 1158 - DNA, 185 bp, Homo sapiens
gaagttgtccagctatctattgtaaacttaggggcatactgtgtgtagaaatgtttgctcctctatcctttgggaacaggaatacattcataacatgctacatgtaaaaaggactccccagggtggccaatcttatggtagaggttgtatggtaatatatttctccttcataaaagtgggaaaat

SEQ ID NO: 1159 - DNA, 244 bp, Homo sapiens
tgggacaactgtctcctgtggttaaggtcagtgggctgtatgtgtctgaaacttcgtcaggactggaaagagatttttcaagtcatcagtgcgtaggtgatctttagagtcactgcaatatatgagatatcccaggatgtagggtgagaagatcagctcttcaaggttagaaggatggacccatattgaaggggttgaggaaaagaagataaagcattaagaaaacgaaaatagaaaaaccaag

SEQ ID NO: 1160 - DNA, 644 bp, Homo sapiens
acagaaaagagtggtgcagtggctactgcgagtgcctgcctagcatcttatctccactttcttcttaaagaagctcagtctcttgcccacaatgaccggtgatttcatccatggacctacacaagccagaccataaagtccttcctgtgatttcatattttaagccacagagcaaggtgtttcttttctcttctgtccttattgaaactatgttatttccaaagtccctttggtgtgctccctgccacaaggcaaaggttcagctgagtgcatttagagatgccatgagttgaaaatgaccacctgtcccttgcagctcaggaagaggctcttaagggaagttggtgggagcactaatgcctgaagaggatttcttggactcctaagtcatctttacttcgtaaagttatctcagaattttgtcagctagtgcttctctgtgaaacttccaaagaccaggaaaccggcaccaaaagcatcccttccacattgtgtcttgcttctgacttctgagctaaacgagccatgaacctgtgccaaatatgcacatacatagtccgtgagctgtgtgggggcttgatcagaagcaagcaccccaatacactatattgtacaagtgtgttacagtttcatctgcagtagaa

SEQ ID NO: 1161 - DNA, 478 bp, Homo sapiens
aagtggaatatctttctgttgcaaatgcaaatgttctaatacagaaactaaaaccagctgtgaagtgataaacctaaaatgtggaattggttgaatcaagataaggaaggttgaaaatctgtattccttgttatatgaaagtgaagcagctgctacctagtgtattttatgcctcaggcaatgtccccaccaccataattacaagaacattatggacttggtcaaaaggatatgggagtgagaactgagacaggcatctgccctggagccctcccaaacacctctgctactgcagtccctgcccaataaggctcataatcccaccccataatcagctttgatgctccctggtgatggaaatcagctcccgattgttccatttttctaagaggtggagacaaggatagatgacgttaatctaaagcccgggggaatcagatgattcctgcaattgttgctaagggactgaaaccacaag

SEQ ID NO: 1162 - DNA, 1057 bp, Homo sapiens
agcagagatactcttacaatatcaaaattcctatttacttagtattagagtatatttagaaatgatagtattaattcaataacagtaaaatgtattattaaacaataatacagtatttttagtgaaatgatccagaaataattacattttaaacttatgggtaaatggtgctctcagataagggaagaaaaccttggctatgtatgacaactgctttttttatttttttaatatgacacagatttattttttaacagtgggaatgcagataatatgaaagcctaagtttatataactaaactaaaaattaggataagcaaataaattgacatgtaaggaaattttaaggatgatagcagtttttgtttcctgtatattttaaatataatttctgattctttcatttcatctttctctttaacatcctatctttaagaatattttctctcattcttatgtttttgtttgcatgcattctcctcaactattttattaacagctgtttacatagataggaatgagaaaggtggttaacttaaaaaacaaatagcagatacagacctgctaggtaatagtgtgataccgtctctttcagatgaaggttcccaggagaatataatcctagcagaagctctgatatatgtagcttcagtttctccaagagtttaaaagttcctagagaagtcacctagcaagaatgaatcatgggaaatagaggactcaccacacttgggtgtctggctgaggtagtgtgagccagatactggatttccagcaagaatatagtcagaaggagtgagctgttctgtgttttctcctaagaccaccagggtttacctccagccttcaggaataagacaaagccaaatacatctaatgtactcatacgaggcaggctgcaggattgaaggggagagagccaggacttccatcaatatagggtcaacagataagaatctgggctcatctgtatattttgccctttagaaagaggaagacacaatgctaggccgggcgctgtggctcacgcctataatccaaacactttaggaggctg

SEQ ID NO: 1163 - DNA, 294 bp, Homo sapiens
gatgcaatgccagcaggcttctttatgatgatagcccttaacacatcttatctctggagtcacactattttgtccagtctggttgtccccagagtaggctgtattgtgtcatcctgggaattcctttctccctacttccattttctcacagtttgtgtttttgatatggtaaagcatgtttttcagtggttttatgagaaagaaaggttggctgagtaaagatagcatgttataaaaattgaatgtatgggccgggtgtgatggctcacacctataatccccacactttgggag

SEQ ID NO: 1164 - DNA, 24 bp, Homo sapiens
ttgaatgtacatgtgccttaacat

SEQ ID NO: 1165 - DNA, 45 bp, Homo sapiens
aggagccattatataaaattattagtgtagaaaagggattattca

SEQ ID NO: 1166 - DNA, 77 bp, Homo sapiens
aataaggttatggttctcaaacttcagtgtacgggaaagtatgattgggttcctgttagagttgactttacagagta

SEQ ID NO: 1167 - DNA, 171 bp, Homo sapiens
ggaccacattttgagaatcaaataaaactaagcaagatttatagtggccagagagaaagtgattaataagtaaggactttattactatccagagatggaagcttctggttttaccctatatgccaaagacactgtctttatagggatcttccccccaggcttcacagtcac

SEQ ID NO: 1168 - DNA, 264 bp, Homo sapiens
tgtgtgctgtttctctttgcttttgccactactccactctgtgcttgaaattctgtgactcttccctgtaagtaataataacaagtctaacttttttcttttgttttaaattcacattcttccctgatagcctccccttctcttaggttgggtagagtaattctcagtgtgtccatttttcttttagcaaacctcattactaaactgaattgtattgtgtctcttttccccattccttcgcatacatacccccaataatttatt

SEQ ID NO: 1169 - DNA, 234 bp, Homo sapiens
tttagcaaataaaattcctatccttgaatgtgttcaagcataggagcaataaataacatctgatagacatgtatgatttaaggacccttttaacctgggtattgactcattaaaactgccttagttctagacttagtaggtcaggtttgcttatgcttgagagcagttagattttagaacgtgacttatttaacatgatattctttagaattttatgtttcttcaaggatagta

SEQ ID NO: 1170 - DNA, 1304 bp, Homo sapiens
atctcatgttcagagagtctgtattacatatttggtataacatgggaatagtttttaattttttgtcacttgggaagagctgaaaaggataggggtatagtttttggtgttttttatagtgttttttcttaaagaatattaaatttagtcattactttcatatcagtgaaatacatatctagcaaaaaggtcacgtttttgcttctaaaaagttatttcatattgaacatgagtactgccaaagagtgtctgggatgataattcttttctgtgttcaacaccataggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcaggtatgtgtataaaaagttctgcatctattttaataacttttgtttatagccatatctctctcctttcactagttatgaaaataaggacacatctagttcagtttattttattcacagtataggaatatgctgcatctgtatagtcaccttatgtataggaacatatatacagaagaacaaacataaaagaaaatgactaatttcttaagctgcagaggaaaaagaattgattggggaaaataatgaagtacatgagataaagtggaagtgtttgggagaaactgtaggactgaagtacctcagtcgaggaaaattgagatgcaaaaatagtaactaattttctaaatctgcaattggagaaaaatatacccttgatcaaaaattaataaccttacctaagatattatttgaccttagagattacataaagcatttgtaaaatcagctgtgcttagggttttcagttacagtgtgtaactttgaaataatatattcagaggttacatcttaagggtcaggaattatactatgcatgttatctaattctttggagagatctttcctttgggtttgatccacaggtaataaaggcactgtagacctttgaaggtgactactctgtttaactgtagggaaccgagagcagtatagatcattgcaattgagcttattgaaaaaaaagacttgaacgttcattcaagtaggccataaccccagcctcccatttcatattttttgcttcacagtcttcctgtaaggacttaaaaagacttttctccggaacacaggtgagtcctaggtcctagatttggagagaactattattagaaaggaaggtgagaaattattctttatgtctttgtccttttcc

SEQ ID NO: 1171 - DNA, 62 bp, Homo sapiens
ttgttacctccccagcccttagtctgttgcttaattctgtttaacatttctcccctcttcct

SEQ ID NO: 1172 - DNA, 483 bp, Homo sapiens
ttaatatttgtagaggggagaagtgctgtctttgtcctggaagcattctattaatgtcctcagtagaatttgtcagccattttatactattgagtcatcgaacttctattaaccacctctacttcattctgtctttgtgcttttggttcactttgacacttaagtgggagcgtgggggaggagaagtaatgtttttgtgtgaaatcatcagttggatcaatttccataagacactgggaatggcatttgttaacaagtaaaagatagtgttgtgcatgtaaagatctaagaacttgatatttctatgaaatcacaatgactgagcaatagtcctttgccttagtttttattccattgagtgctaccttaccattgtccatactgtgccattactaattccctaaccatatgctcctcttagtaatagtgagaaaacttgatttgctagtgaggagacctagattccagacccagtttggacat

SEQ ID NO: 1173 - DNA, 581 bp, Homo sapiens
ctttttcacttatagaagatctttctataaagaacacaaaaattacttaagttacagccacaaaatttgctaagattactgttttttattgtaatatgtgttattgttgattgtattcttgattttaatctttattctggggcaacataatttggacatgaagattttatggccattaagtatagaaatattctcttttttttatttgcttgtattcatctttaaggaacacatttgtccattaaggtccattaaggtgagctgtacttctaatttaagagtgtgtatttataaaagaaaagttggacttattgaaccctggattctacaaatagagatacaaatataatatttttttctttaaaaggcctaaactatagaatatctattttaatagttatcttagccagttaatggtgattagtgttaacaactaggaaatagtttttatcaaaagagatgatcaaacaaggagaggatcttctagatgggagacctcattaatattccagaataaagtttccaaaatatacaaggtacagttctcttgttgtgagaatagattattactttaaattatc

SEQ ID NO: 1174 - DNA, 88 bp, Homo sapiens
gagggtatacttgggatatcaaggaataacagaaaggtatggctggaatagagtaagtgaggagggaagtgattggagatgcaattta

SEQ ID NO: 1175 - DNA, 239 bp, Homo sapiens
gttgttgttgttgttaatgcacttgaccagcttttcacatatttattgactaaatgtatttttgtctatgaattgcctttttataaactctgctgtcccgagattctcaatctgtggtcccaaggcccctgacatgtaatataaaatgttctatgcttattggttgtgcattattctcaggatagaggacaaggaacaataagaaccactgatttttgacttcctgctggcaaggataa

SEQ ID NO: 1176 - DNA, 1225 bp, Homo sapiens
taaagaaccactgattttaacgggtatacgctgaaaagtatatgcggaaagaaagaagcaggcctagaagaaagggcgtaaaagaggtgaggcaggcttctatgattccaaaccagagtgtgcacacacacacacccttttattatctctccctcaattacactaggacttcccaatagtattttctcattttccttcccagaaggcccaccagccagaggcaggctcctagatctactgcagattgggcttatttctttaccaatatctttgacatatcacagagaataaggacaaacaagtcaagatgctgctttatttacattttggtttatagacacattcaaaactttatacggacaagctgtcacctatttttttttggaatcaggacagccattaacttcaattctaactcctaaatatttctctaatctgcccatttctcttcatttccactccaactatcgcatcttgctttgaccatggcagcactctcctacctggcttccccatatcctctctgccatactctccaatccactgtccatgctttaaccaaaactatcccttcactcaccagctctcaacctgtccatggctgctctttgctctctggctaaaaggccaacctcttggtgcatgtgtccaactgtgcggtctgcctgacctacctcctctatgatgctgagcccctcttccctcaccctggctcccaccacacctgggacactcagccattctctctcccataccatgacctttgtcattctatttcttctgcctgaatgctgtctctcccactcttttctctcactgagttgacttctactcagcttaaaaataacttccctgacttcccaggccaagtcatgtgctgctatttcatgctttcataacaaaagcataaaatactccacttgttttctttagcagctatcccaaattttcaataatatagttcattaacatctgcttccactctggcaggagacgtccatgaaaataggatgggatctgttttgctcttcttgaaatcccagagcagggctaacccagagcagatgaccaataagtactgttgaagcaggaagaggaaaaggatgcttttagaaatgatcctttgtaggcctttatttttctttacactttccttccaacctgagaggatagtaactatgtcctggatatggaaatttgctaaccctttcaaggcattcccggc

SEQ ID NO: 1177 - DNA, 68 bp, Homo sapiens
ttgggtgaaagaagaaagaagagggaactcacacccattcgttgtatgttaaaaaaccaggttgggga

SEQ ID NO: 1178 - DNA, 352 bp, Homo sapiens
ccaactaggttggggagatagacatagagggggtgtcatgaagtgacataagctcatgaagtttaaactaagtttgagaaaaacaacagaaatagatacacatacatactaactctagtagtaaaatatcgtgtacaccggcttgtgagctgccttgagcagcgtgctggccggtttgagtagctcctctcactccccgagtccatccacatcttgctcaagaacttcaatttcaatgttaactctattcctcagaacccattccttctccttggcatggctggtggatctttcttccatgttcctaaggccttctgttcacctttaaggtgtcactcatctccctgtccta

SEQ ID NO: 1179 - DNA, 210 bp, Homo sapiens
gaaagaatgggtagagaatgaatgaagggagttagaatgagtgtagctctggcaattggaatgcaccttgttctgagcagctgaattctccagaaattctccgtacgtgtgtgtgctcatcttcagcacttctgcatccaagaatactggtagtcagacaagttattctctagaggtaatcagaaatgcttggtttagactcattagtgg

SEQ ID NO: 1180 - DNA, 131 bp, Homo sapiens
aaggtcaagtgatttggggacatgtggcccaatttgcccagaacaccctgctttattcttattggcccagcatggttgctaccttcaaaataataactttcccagtgtgtactgtaaattgggtgatcacg

SEQ ID NO: 1181 - DNA, 171 bp, Homo sapiens
ttatgtaagataaggtgaatatagaaaacaaaaattaaaaaattaaaagtttgataaacacttttcttgagagactcaaacttctgagactccggggaagcagcatcgaggagaaaaagccagggaaaagcagaagaaagaaaagaaaattgaagtgtggctggatagctt

SEQ ID NO: 1182 - DNA, 323 bp, Homo sapiens
acacactgaaaagtaaaagcatcttgttctacacatagcaggggaaaggatttttttccacttcttggacaccacaatatttgtaaccacatcaaaattgaggaggggataatggaacatatctcccagtgtcctgttatgacttttgtaatttaagaaacatacttttattttggaaatattctgcatttgaaagtagttagcattttgattcagagatcagttcttaattatggaccaaaaaagtgggtaagtgtttcagattgatgaaataagccttgctaggcaaaagcaaagaaaatgagtagttctgtgcaaagtgt

SEQ ID NO: 1183 - DNA, 118 bp, Homo sapiens
accacagtcaaaatagaaatcaagacgattggagccaaaggtgctctcttcttacttttatttgttcttcccatcatcatacgccccccaccttcgatggtcttcctctagctgctca

SEQ ID NO: 1184 - DNA, 295 bp, Homo sapiens
actccactgaatgcttcagggctgaatgaggactcccctttggctggtcagacaaaaaacactttcccatttcatgtgtgctctgggtttattcagcttacaactaaaaagtcttttcttgcccagacttgtagagcatcattctacatacttgtatcctaacactcagcaaaaattcaagagattcctatgcatatttctggagctctttttctgcatagcttcctccttctcagaactctgccccagtacctctcaccacctcagcctccccaaactctgatcttcatctcat

SEQ ID NO: 1185 - DNA, 394 bp, Homo sapiens
aattacaataatttataatgggcagttaggtcaggctattattattccatcatgactataaggtgatgtcccctctacttatcatttgataggtagaacttactatgtagtatactctgggtcttcagactttccaaagatttggtaaatttgactgacttgtatgtagctagagaacaaagtgtagaacttttcctgcggtttgcctaaatagttgatatgctatataatcattgaccacaatttctcatgttcaggttacgacagagaagacaaagagaacttgatagaagaagctgaaagaagggtagcttggagctatgcatttctgaatctatttgtacatttatatcagaggtagaacaagcatattagcaggcctagaaaagatgat

SEQ ID NO: 1186 - DNA, 464 bp, Homo sapiens
atgatgtacctctttttaaagcatgtgaaaagtttaggaagcaattatcattagctccagatgctatattatgtgaaacaaatagagctgtatacctccaggtatttatagtgaaaaaaaagaactgatccaaaatacagataaatgatagagatagatagatggatatcccccaaaaagtttgttttatattagtggcatttctttattaagagatagaaactacaatcagccgataaaaccaaaaaggaaattaaaagtaaaaacaaacaagcatctattttctcgcacctgattagaaaaatatttatttcataaaaatgtgaagaacccatttgttgaaaatagaatgagtagttatacttttagtcaaggtggaggagatggaagagaactgggaagagaataacatcaaagatgggtgtcaaaaatagaagattcaagaatcatataaaggggtagat

SEQ ID NO: 1187 - DNA, 296 bp, Homo sapiens
tggatggatggatggatggatggacagacagtaggaacaatataatagaagagaataaacgtgatacctgaaagtgagcatttgatcttgtagaacagagaagaaatctaatggagatagacagaattgtcatgaagggttttgtaggatggtaatttgtaactagtttaagtgcaaataagttttcccccagttaattcatgattgaaacttcatctcaaaggtcaactttctgaaagagaccttgagcatcagtctagattaattcacctgttttatttgtcttctggtaccat

SEQ ID NO: 1188 - DNA, 116 bp, Homo sapiens
atgtaagtaagtgcatgaattcaagaatgaaggagggtggtacttgcggaaatgcagagctgtgagacctacccagcccccatgaggactgagcctattcatccaaggagtggctt

SEQ ID NO: 1189 - DNA, 603 bp, Homo sapiens
gtgcttagaacttctccagtgttttctcccaagaacccttctggaaaaagcgggcattcacatctgtgttgaactcaaggtacactaaaaacaaaagcaacttctttgaaacaaattttagctaaaaagttcgtgcaaatgcttcattttataccataatatatatctacattgtctcaatgttgaaattctgttttaaattattcatcagttaatttagatttttatttcataaaataatggtataaaatggatgtttatagaacacgcaccatattatcctttgcttttccatatttttgagaaacatggattgatgtaaaatgacctgctacatggtgggcaggacctccataagtgtttgctgaatccgaatctgcccaccagaggagctgcagggttgaatcaaaagcaaagcttttgattgatgcaaagaggatttctcccacaggaggagtgcccaggcaggctcctaatctggggataaatcaaaaggtacaggtcaaaaatgacctataaacttatttgaatctagataatcaaaaggaaatgatcagtactatataaaatgtaggctatatgtaaaatgattatatatttacc

SEQ ID NO: 1190 - DNA, 51 bp, Homo sapiens
ctggactgtctacagagaaaaaaaacatacttaattgtaaagattactcct

SEQ ID NO: 1191 - DNA, 235 bp, Homo sapiens
gcctcctatctttggttttattcttagaacctaatgtaaaacaaacaaaccaaccttccccacccccagctctattttaacatccagactttggtctgctctgaatctgaattcaccatgaattcagctacacatttagctgtagctcaatttctatttccaaggctttgacccaatgaaagcattaaacatactatcacaaaagcaaacctccctatgaacaaacgtggtctgc

SEQ ID NO: 1192 - DNA, 49 bp, Homo sapiens
accacccaacttctagggtttattcactgctttatcaccaatttccact

SEQ ID NO: 1193 - DNA, 125 bp, Homo sapiens
cctattccataaatgtccaatcctgagcctggcacagatatttagcaaatatttgaagactggataaatgattctatttccaaataccaaattagaacacagtctgaaaaaaaatgtattacctg

SEQ ID NO: 1194 - DNA, 814 bp, Homo sapiens
gtcacacttaaatcaccttaattggaaagggcaaaatgtcatgaaatccatgctggtcttggaaaatccaattttggtagagtacatccttaattgtttaacatccaaactccttggcctaaatttaagcactgcatagctctctctcttgccagtccaacctcatttccccaagtcccccacaggatccatctgctgaaaccacactggtctctgcatcacttccagaaataccatcctgctaggctcagctcaaacccctcttctcacatgaagccttcttcatcctctgaagccaaagtaataaagtaataccactttctttagggacttttttttttttaatgtatcacttacttcctcataccattagttatatttgtgtgagtttatctggtttctattctaggttaaaaactccttgaggacaggaacttttaaaagacttaattctaccctatctaggttggagtccagcaaatattataaagagattttaattaaatcactggaaaatacacagtcagcatttacacacaaccccagccttgaaagcacagggagccagagaaggcactggcaaatcaaagtctgttaacattaacaacttgagcacaagttctactcaaagtgggaaatagagaagaactacaataacatagttcaaagtgatgctgtcacttccaaaaggtatcgctttaccgttaacaccagtataataaatatccatcatgccctacttttgaataatatctatttgattaatgctgggcatttccttcccaaggcttcatactattcctcttgccacttg

SEQ ID NO: 1195 - DNA, 238 bp, Homo sapiens
cccctcttgctgtttttttgattaagtaggcatttgcctcagataaccagatcagcagcaggaccaagaaatacacttcagctgttttgtgggctttggcaaacagttaatgtgtgtttgtgcaatcataggtagaaggaataccataaagaattaattacttttttaaaaaatatctgattcttctgattcacttgatatgaaacatgagccaatgtcaaacaaattcttttctctt

SEQ ID NO: 1196 - DNA, 273 bp, Homo sapiens
ttattttctctaatttaatgggaaaaagcagtgtaatattcctcaagtggctttctagctgcttgatcccatcttcatatgacctttaaaaattttgttgctatatttcttttcatataattgcatccaagcaatatgataaataaaggtagttaggatgaggcaggagagtggttcctaacctcacacataagcacgaatgtcagtccttggctatttcagtaagcattcttcatttaacccccagtctaatatttttatgtgacataacaa

SEQ ID NO: 1197 - DNA, 50 bp, Homo sapiens
ataggacatccatttttatgtgatataaaaggacgttttatatgaaactc

SEQ ID NO: 1198 - DNA, 192 bp, Homo sapiens
ccttgagaaatggctttaaattatactattttgagtaaagttgatactttcaagaatataacagaggtactaaagcaagtgataagccataaggtataagatataaaaatacaaatcaatactagataaataatagtataagcatcctatttatggagaaataaattcaaattttaaaagtcatgtatatgt

SEQ ID NO: 1199 - DNA, 174 bp, Homo sapiens
gaataagaaaagttatttttatggccaaggaaattagttgttagaaaaatatagaactgtctgttaagtataaaaattgtaacagaaactataaaaaagacaaagcccttgctctaagtagcttataaacaactacaagagttcaagcaaactagaaatgtatttgggtttgtg

SEQ ID NO: 1200 - DNA, 234 bp, Homo sapiens
gctaactagaaatgtaaagtgcacagagtggtagtgctggtaataattctagagtataaaaacaatttaaaattttttggagaatttgtttttcagatttgaaaagaaaaggtgaatgatacacatatctgtttaaaacaatgatacaggaaaggttttctttaaaacaggctaaaaatttttgccttcctttcctaatttctaaagatgatggaatagaaagaccattatctg

SEQ ID NO: 1201 - DNA, 65 bp, Homo sapiens
gagagagagagacagaaattaagactgttatctggaattgaaataataacataatcaacagtgtt

SEQ ID NO: 1202 - DNA, 1011 bp, Homo sapiens
tcagacacagcaattgctgtgtctgaattatacaatgcatctttgtcagtcatctgtaccaaatggtctagattaactggggtttttttttttttttggaggggggggcgttgttgtttgtttgtttgtttggatctaagggtacttctgcaggtgcagaagaaagttaagggaaatacattaataaatgtgactaattttgtcattatccaaactacactactcatttgataactaccacctaatgaaaattgaaaagtcctgaggactggactccagacaggtactttcaaatgcatcataactgggaacaccttgagatatgtggttcgagaaagtaagctgatatcctaccaagagtgtctctcctgggaggtggtgacaaatgctcctcaagacttctcctgtttcctcctaaatcttgggaactcctttaagacgccctcatcttcatagtaccaaatgaaagaaaatcaattgcatttgaaacaatttgccacataagaaaataaacaaacatggaaaaggagacacattcgtgtgaatctcaggggaaatcttatttttcagatattgatgaaatagcaaaagaaacaagatgagtttagaataccatcatccattcctgcttcttttgaatccatttcccttatctttagtgcagaaaaggaaactgattagatacattactgtgtagcaaaagttgtactcaaattttgaaagtgtttccctcctttttaaaaaactaaatgtttctcttttttagaaagtgaattttctctattgagaagataccatgaccactaggcagaattatatatttagttgtgctagagcactgatgacttcttttatgatgatttttttaaatgtttaaatattcctcataaacctgcaaaacttaagtgctagactctataacgtttcatagttaatagacccatttgcaacagcaatgagaaaaatttaaatttaagtccagacacgtcacataaaattattgactggctg

SEQ ID NO: 1203 - DNA, 229 bp, Homo sapiens
ccaacaattattgacgggctaaaatattctggaaaatctaataaactaaacatattgatgtgagcatgaacacaatatatattgtagatttcttgttcctatcacaagcaagtaactttaagggcaaagcacaccaaaaaaaaaaagccttttacataattcaaagctgtccatactttcttttatcctcttccattcttttttattatttttttttaatttttattta

SEQ ID NO: 1204 - DNA, 636 bp, Homo sapiens
aacagtatcttcaagacaaggggaggaagggaagacacactgcaatatacatctggacatattttaaagatattcacgatagaagaaagcacaaattaatgaataaacaattggatagatgacgtgccttgtttgatgtgagaacacttaataaaaggttaaaattaatgagctaagggaagaaaacatggctaaaagggctggtagctctgtaagggtggggacagggcggggaacagagtcagggagacaaacaggatgctgggaggtgagaaataagggtggggagtagtgggcaatctcaagaggaactaacaaggccgttgcttatagttacccagaaaacctacgaacaataacagacaagcagatgcagctcagaaagaaacagcggagcagctagaagcccctcctgctgagacaacgcaccagacacgttaatggtgtttgggggctgcaggtcatctctcacatactcacatccacaactgctgacacctctgtttcccgtcgaatcaacagatcctggcaaaagacccccagagaggatgaatggaccttgatccaggagttttaatatattcctatctcttcagaaataggaacttcggctctactcattctagtttgctggct

SEQ ID NO: 1205 - DNA, 141 bp, Homo sapiens
ttgtgtttgtttttagcttttcttctttggaaaggtttgtcaagtaaatactgttacgtgtcattttgaagaggaaattccagttccaagaaccagcacaggtccaactatccaagcagtctttaaaaagccaaagagtcg

SEQ ID NO: 1206 - DNA, 209 bp, Homo sapiens; identical to SEQ ID NO: 205

SEQ ID NO: 1207 - DNA, 224 bp, Homo sapiens; identical to SEQ ID NO: 206

SEQ ID NO: 1208 - DNA, 712 bp, Homo sapiens; identical to SEQ ID NO: 207

SEQ ID NO: 1209 - DNA, 590 bp, Homo sapiens; identical to SEQ ID NO: 208

SEQ ID NO: 1210 - DNA, 240 bp, Homo sapiens; identical to SEQ ID NO: 209

SEQ ID NO: 1211 - DNA, 1145 bp, Homo sapiens; identical to SEQ ID NO: 210

SEQ ID NO: 1212 - DNA, 388 bp, Homo sapiens; identical to SEQ ID NO: 211

SEQ ID NO: 1213 - DNA, 955 bp, Homo sapiens; identical to SEQ ID NO: 212

SEQ ID NO: 1214 - DNA, 174 bp, Homo sapiens; identical to SEQ ID NO: 213

SEQ ID NO: 1215 - DNA, 87 bp, Homo sapiens; identical to SEQ ID NO: 214

SEQ ID NO: 1216 - DNA, 27 bp, Homo sapiens
tttttttaccactaatatttcagtata

SEQ ID NO: 1217 - DNA, 323 bp, Homo sapiens; identical to SEQ ID NO: 216

SEQ ID NO: 1218 - DNA, 487 bp, Homo sapiens; identical to SEQ ID NO: 217

SEQ ID NO: 1219 - DNA, 2198 bp, Homo sapiens; identical to SEQ ID NO: 218

SEQ ID NO: 1220 - DNA, 122 bp, Homo sapiens; identical to SEQ ID NO: 219

SEQ ID NO: 1221 - DNA, 52 bp, Homo sapiens; identical to SEQ ID NO: 220

SEQ ID NO: 1222 - DNA, 1104 bp, Homo sapiens; identical to SEQ ID NO: 221

SEQ ID NO: 1223 - DNA, 56 bp, Homo sapiens; identical to SEQ ID NO: 222

SEQ ID NO: 1224 - DNA, 736 bp, Homo sapiens; identical to SEQ ID NO: 223

SEQ ID NO: 1225 - DNA, 995 bp, Homo sapiens; identical to SEQ ID NO: 224

SEQ ID NO: 1226 - DNA, 165 bp, Homo sapiens; identical to SEQ ID NO: 225

SEQ ID NO: 1227 - DNA, 523 bp, Homo sapiens; identical to SEQ ID NO: 226

SEQ ID NO: 1228 - DNA, 136 bp, Homo sapiens; identical to SEQ ID NO: 227

SEQ ID NO: 1229 - DNA, 102 bp, Homo sapiens; identical to SEQ ID NO: 228

SEQ ID NO: 1230 - DNA, 221 bp, Homo sapiens; identical to SEQ ID NO: 229

SEQ ID NO: 1231 - DNA, 713 bp, Homo sapiens; identical to SEQ ID NO: 230

SEQ ID NO: 1232 - DNA, 102 bp, Homo sapiens; identical to SEQ ID NO: 231

SEQ ID NO: 1233 - DNA, 107 bp, Homo sapiens; identical to SEQ ID NO: 232

SEQ ID NO: 1234 - DNA, 1069 bp, Homo sapiens; identical to SEQ ID NO: 233

SEQ ID NO: 1235 - DNA, 482 bp, Homo sapiens; identical to SEQ ID NO: 234

SEQ ID NO: 1236 - DNA, 45 bp, Homo sapiens; identical to SEQ ID NO: 235

SEQ ID NO: 1237 - DNA, 389 bp, Homo sapiens; identical to SEQ ID NO: 236

SEQ ID NO: 1238 - DNA, 495 bp, Homo sapiens; identical to SEQ ID NO: 237

SEQ ID NO: 1239 - DNA, 317 bp, Homo sapiens; identical to SEQ ID NO: 238

SEQ ID NO: 1240 - DNA, 199 bp, Homo sapiens; identical to SEQ ID NO: 239

SEQ ID NO: 1241 - DNA, 345 bp, Homo sapiens; identical to SEQ ID NO: 240

SEQ ID NO: 1242 - DNA, 126 bp, Homo sapiens; identical to SEQ ID NO: 241

SEQ ID NO: 1243 - DNA, 152 bp, Homo sapiens; identical to SEQ ID NO: 242

SEQ ID NO: 1244 - DNA, 324 bp, Homo sapiens; identical to SEQ ID NO: 243

SEQ ID NO: 1245 - DNA, 25 bp, Homo sapiens
atggcagaaatttgaggaaaatcag

SEQ ID NO: 1246 - DNA, 121 bp, Homo sapiens; identical to SEQ ID NO: 245

SEQ ID NO: 1247 - DNA, 233 bp, Homo sapiens; identical to SEQ ID NO: 246

SEQ ID NO: 1248 - DNA, 453 bp, Homo sapiens; identical to SEQ ID NO: 247

SEQ ID NO: 1249 - DNA, 760 bp, Homo sapiens; identical to SEQ ID NO: 248

SEQ ID NO: 1250 - DNA, 132 bp, Homo sapiens; identical to SEQ ID NO: 249

SEQ ID NO: 1251 - DNA, 874 bp, Homo sapiens; identical to SEQ ID NO: 250

SEQ ID NO: 1252 - DNA, 1311 bp, Homo sapiens; identical to SEQ ID NO: 251

SEQ ID NO: 1253 - DNA, 77 bp, Homo sapiens; identical to SEQ ID NO: 252

SEQ ID NO: 1254 - DNA, 62 bp, Homo sapiens; identical to SEQ ID NO: 253

SEQ ID NO: 1255 - DNA, 341 bp, Homo sapiens; identical to SEQ ID NO: 254

SEQ ID NO: 1256 - DNA, 285 bp, Homo sapiens; identical to SEQ ID NO: 255

SEQ ID NO: 1257 - DNA, 89 bp, Homo sapiens; identical to SEQ ID NO: 256

SEQ ID NO: 1258 - DNA, 45 bp, Homo sapiens; identical to SEQ ID NO: 257

SEQ ID NO: 1259 - DNA, 257 bp, Homo sapiens; identical to SEQ ID NO: 258

SEQ ID NO: 1260 - DNA, 84 bp, Homo sapiens; identical to SEQ ID NO: 259

SEQ ID NO: 1261 - DNA, 227 bp, Homo sapiens; identical to SEQ ID NO: 260

SEQ ID NO: 1262 - DNA, 830 bp, Homo sapiens; identical to SEQ ID NO: 261

SEQ ID NO: 1263 - DNA, 51 bp, Homo sapiens; identical to SEQ ID NO: 262

SEQ ID NO: 1264 - DNA, 95 bp, Homo sapiens; identical to SEQ ID NO: 263

SEQ ID NO: 1265 - DNA, 83 bp, Homo sapiens; identical to SEQ ID NO: 264

SEQ ID NO: 1266 - DNA, 94 bp, Homo sapiens; identical to SEQ ID NO: 265

SEQ ID NO: 1267 - DNA, 35 bp, Homo sapiens; identical to SEQ ID NO: 266

SEQ ID NO: 1268 - DNA, 283 bp, Homo sapiens; identical to SEQ ID NO: 267

SEQ ID NO: 1269 - DNA, 183 bp, Homo sapiens; identical to SEQ ID NO: 268

SEQ ID NO: 1270 - DNA, 278 bp, Homo sapiens; identical to SEQ ID NO: 269

SEQ ID NO: 1271 - DNA, 183 bp, Homo sapiens; identical to SEQ ID NO: 270

SEQ ID NO: 1272 - DNA, 30 bp, Homo sapiens; identical to SEQ ID NO: 271

SEQ ID NO: 1273 - DNA, 288 bp, Homo sapiens; identical to SEQ ID NO: 272

SEQ ID NO: 1274 - DNA, 219 bp, Homo sapiens; identical to SEQ ID NO: 273

SEQ ID NO: 1275 - DNA, 1130 bp, Homo sapiens
gttggcatttggaataatacttggattcagcacagaatacatatcagagtaattcgggatggaatcacttgccacccttagaatgaacctgaaacactaaagacgaactaattcatttgggaaataaaaatgtaatcaccctcccttgtatctgttgcaacaattcaatctgcagtgaaacttacacttgtatcaagtgtgtggagtgttatcactgccattccttttataatcttctatacaaaaaccagtcataatatattctttcattttgaattttttataccaagaaactgatcttagtaggatttgtgacaaagaagtatgcaatcattcaacaaatattatcccaagagtaggaacaaatagaaatcaaataatgcaaggaaataactgaaatgcttcactgtgattatctctgaaattgtttttttctttatgctttactgtatattctacattttgtaaatgaagatacctaagtttcattactgaaaacacaaatattattaacttttaaagagactgggggaaaacaagatatgactgttgatgcatttaacataatacgaaagttcatgtgcatcctggaaatgaaaatgtatgacttcttccagaaattccctgaattcagatccaagtaccttccgattctccataaccacaaatggctgaaagagaggcttttcttttgcagcctaacgaacttcctttatcaaagagtacaaagaatctttaactgtttcaatttcaggaacatacagtatcactagtataaagtgaaaccatccaataaatggttccacaatgcctagtgctatgagaaaaaaaaatcgactattattctattttttcacaactcatatttttaaaccattactgatttctgaaatatacacctgttatctaaacttactcttgctaaatcaagctttgccaaacaggaatctgagggctgggttatttttaaagttttatatcttactcatatgccctctcaaactttctgagcctaatcccatgaaatttcccaggtgaaattcctattctcttctttaggtagcgtctgcctgaaaggcatatgcacacgtatgcgaaacccatgaagaccctcagagcttccctagggc

SEQ ID NO: 1276 - DNA, 1245 bp, Homo sapiens
gataaaatcaggctctgaaactggcttagagtcacttaggtaggggccagcctctttttttttctgttattatttatcaagtgtctataatgtaccacacactgctctagaataaaaaactacagcccatgctcccggggtcaccaaacctttggaacatacttatgataaacatataaaaggttgttatttggaattcaaatttaactgggcatcatggatttttatttgctaagtctggcaatcctatgtattcatgtccaccatgccatacagcatgctaggttgactcagcggcccatccgatccttcccagcagaccatgttgatatgcaatggatggagacctccaggaatgaggtctgggatgaggactccagggatattgaattgcagattccaggggccctgggatggaagccacaagacacattgggatggagactctagggacgctgggatggacactctagagacattgggatggagacgacagggatgctggggtggaagctccagggaaactagaagacacagagatagagacttccaggaatgctgagatggaaaccattggagatattggacagagacctctagggatactgagagagagagagacaccccactgacactggaatagagaactccagggactctgggatgaagacctcctgggacaggtaccccttgaaaacaattcccagctgccatccacagccagaacaggagcataagacatctcttcaaaataccctaatttgctctgtggcttctcacatcccttaggaaaatcttgagtcactgaccaaaagccaaccacttgcagagaatgaagcgctggtctgttcacacagcacccaggacctccagagacaacaagagaatctcatgagtcaaagtcatagaaaagcctttccaaagttctttagagatgaatgagggatgcaagactcaaaacactaattggggtcacatttgtacctgccccaccccggtaaggggtctgttcccttgactcagagtgaaagctcattttccctcagggtgagctttggtgtatacagcctgccactggctcatgcccttgccagatgtaggtgtctgagataaattgttataatcccaacccccttttccctaagtgttcacctggatgcagaggggaacatagacaaattcaactctggaaataaatgtgttgaatcaacaggtatctttgagcttctataagcaggaaaaatc

SEQ ID NO: 1277 - DNA, 1021 bp, Homo sapiens
aatgaaaacaggcaagtctggaagggaagtgggaatgcagggcagaagggctggcgtaccacaccagggagacagcttatatccaatgggagctactgaaggtgggcatttttaaaagatgatgttggctgtggtatgcagaaggaggagaacatctggaggccaggagactgatttaacaccactgcaaaacacaggccgaactccaagtgatgaaatttgttggaagtgagcatcagaaatcccccagtattgctactggactaaggtaaggaagagaacaccaagtagccttgtccaatccatactcaccgcctcctcacaaacgtcaaaagaggtgaaggtaacttgctaggtgcaataaactatgccaacttcttcctactcatgtaaaattacaaccattcatcacttcaagtgttgagtggatgtacaaggacacctcaagatccaagagcaaaagcaacgatcctagaaactgttcaatgtttatctagagtgcccagactataagctagatttagctgcactcgtgtttatagagagactgcaaaacctctgtagctatggcaggcatgctttatactctggtacatttggacaaaaaatataatgaactctccactgcccaatgtgccatccttagatgccagaggaacccaattctacaaatggaccctttcttaaactttaatgtcaattttcctaaaagatggatatataatcccaaaataggtaatttaaatgcaaggattatgcaggttttctaaggaagtgatagtgaaaacaggggaaagaactcaaatttgtttggattgtgttccagtggcctcattgtcaaactgggatgcagatgttgacctagatacgggaacactcacacccttaagagataaagataaaaataacttcgttgaatctcaatttactggtatatggcctaatcaaggtaacaaagaaaggtggtggtgggccttggggtacacatcaagatctctggatctctagaatcctactgaag

SEQ ID NO: 1278 - DNA, 299 bp, Homo sapiens
tactctaacgggcagccatcaacatcttattagcagtagtatattttatgacactcatactgtatttcattcttataagaaataatattattcagcattcttcagttttgtcagtgaaggtcacatgtaactgcacagatgtaaaatgaagtccaaaaatatctgtggtggcaaaatacaatatctctcaccttgctcctacaacaagttctttctgtcctgggtcaaatgttaactgcgagaaatccacagcattcttcgctctgaactcccgtaaccaggggccaatttctaaatag

SEQ ID NO: 1279 - DNA, 1733 bp, Homo sapiens
cctctggggaccacagatagtgcacatcaggtagcagacgttacatttcagagaggattcggaggtccctctatgccatctttcagaggccactggaggtttccctcaggatgccccataagccatactaagaacttgtaaagcacagagggcagccacccaataaagagcaagcgaggcatcaatgcttggttgtgatttacaagccagatgtgcattttccttttggctttgggctgggcagaaaataacacagcattcacatgattcatcagaggaatactgaatgcaaacaagaccatttcctgtgcaacttgactcaaaagagctgcagatttttaaatattacaaaagcctccttaggagcaaggaccaagcacacaagcatcatttgccttctttcaaattagatgttccatttccctgtcctttgggtttctattttggccccatgattagacttgttaaacacattccgacctttctagatgagaaatccacagttacttctaggcttcatttgcatttttttttctaagggaaatcagaaaatagccactctatagagacaggcttttacaagcacggttaactcctattagacagcctccagcccagagtccgataattataaaatgacagtatttgaggagagataggatgctgcttcaatgagccatttttgcaactttcattagctcatttttaacactaaaaaatattcagtgagttgcccaccaaacgtgggataccttatcattatcattgacaattaaccataacatctgattgtcgttttttcttggatttagtattttgaataacaccaccctgactaaccaggcacataacaactgtcaaatcaatgaagatgttggtttgaggaaaaagtgtgtgatacaggaaagaatctcctccaacaaacgctgatgctaaacacatcagtgttatgtttttaatgggggcatatggaaatatgcccccattccgtctcatatcctaaagaaatcgctttgttgatgtgaatgagagggactattttttcaggaatggttctgtataataaacatgtcttttctctactaacagttacgagggggaagtgatatcaagtaaaatttatcttctgcttaaaggaaaccaggggtgagtcatatagagagggacttgtaatgtatatgatagcttgatttttttaaggattttcatataaatttctacattttataggcaaatcaattaaaatacgtagaacaaggtatgtacaaggcaatggaactatgaaaagttattaataatccttccaggactttataattcagttaaagaaacagcactagtatctttaaacagggtgtctatcaatgcaagtgtttataggggcttgtggggttacaggaattattcttatatgaaaagaagagatgattgagagctgcagtaaaacaagaggaaagatttgaccagagagtgacaggaaagatgtcctagaggggcaaagcaagacagcaacatgggaggccatggtgccccctgtggccataactggtatcactcatcttcactccatcaatgcctccattcctgggcaaaagagaacccaatggctcttgcgtctgcattgctccctgcagtgcatgcagcatacaaaacagcacattgaatgcgataggaaataataaatatgtgaaatgaagtaagaacaagtaagtgagttcaagagagaaataatc

SEQ ID NO: 1280 - DNA, 1554 bp, Homo sapiens
gtaatagcaacttaagaaactactaggaaaggaaactgaaaggtgtatttaaatacaaactgtagaaaaattcactttcaggttaaaaggtttggacttgatttcatatgtgacagcaaagctttgaaacgttttcaggaaaactcttgacccatttgagcagatgtctttggaatatcaatgagcccttgatagaaagaatggtctggaaagagtagagaatggaaggaaaagtagtatatttttaaaaacctaaaaacctacaatttaggtattggccttgaaaatgaataaagaagatgtgggatcactgattagagatgaagtcaaggtaaacaacttaaaaagaacaaaacagttaccaaattaaatgaagaagaaaacagtgatgactgagacaggcatcagagtttgaggtggctttagagaaagatagtaaattcaggtgcaagaatgggaatgtttcaggtgaaaaatttccaatggtaggttggcccacagccattgttaaacatcgctaagacctagaaatgtccataaagatgttctagttcaggaggttcatcattcagatgggaaacacatgaccagggagcactgccaggaccaggctccagagtgaatatcaggggctctgttcaccacaactcacagcccccagagctgggctcacatccaatcttcaaaccacatgagggaagaacagagggccaagggctgaccttcctgctaggggagtgaagagatgagcctctaagaggaaaaaagactacgaaagatagaagaaaatcaggttactcttttcccatgcattcatctttctttttatttagaagacttggaagaaagtggccaacaggaaccaggctaaagagacatacatcaggttttggtccctatactgaacaacgggaaggcagttttgctacttcctaaaataccctgaagtaataaaaggagtcatgtacagaggaaaaaatgagttaacagcatgtagttctgtcaatattgttcaagtttccttatttgaaattctaatgaactttcccaataaaactgtgtatttttatggttaacatagatcaaagttgagtaatctgcatattcccttctctttcctccagaaggttggccatctcaactttgcatattacattggcttctatctcactgataccaagagagccttgcaagaaagtctctgcaccaactcacctcttgaactaaaaagaagcctgcaccaatacctatcctcccaactttcccaacagatcagagaaaaggcactcaatcctcttttcaaagaccagttgctctcatctcttctttcccctttaatcgcttctcaattacctaggctttcctctaaaatctccaatgttacctagtccctttccctctgcctatatgtacatcctctcctatttcaaaaagcattacatatttttattacactcccttgttattatagcttcaaaaaccccaataaaatgcataataaacttccaagtacaatatagcaatatatcaaaaaaaaaatcacacacatacaaa

SEQ ID NO: 1281 - DNA, 324 bp, Homo sapiens
cacaataacagatttcagtagtagcaggaaaacgtcatcaatactgctttctaaggaatcagaaaatgaacagttttggaaatagaagatctaaaagagttcagggcaattggtcacaaactagatgccagaggaagttcggggagagtgagggagcaggagggggtccacagcaagtggtgaattgaggggatacaattttcaataacattaagatgctcattgcccccagtgagtttacctttttcctcctatccctattttctgatattgctgaaataaccatatgatgaaatggagcttaaatatggcagccaatatgac

SEQ ID NO: 1282 - DNA, 394 bp, Homo sapiens
aaattggaagttaagttataacataaaatttgtaaattccaactgaacacttgatagataattcataatatttgaggttaactatcctagataatccaatttttacacatatatttacgtgattgttgaaatatggtctccagcaatgattttttattgcaaaattacattcattgattcttagttgccttctcttacagctacataagctcgcatgtgattggtgtataaaatattttatcaaaagtataattccattttttttaataatccagtcttacaacttcaagaaacgatttattttatgaacaagtcagtattaataatttggtccaaaatacttgacaaatataactagagataagctaaatagattcaagttaatgtcccttcc

SEQ ID NO: 1283 - DNA, 102 bp, Homo sapiens
agaaaaagaaagggaaagaggggtaaaagctactcttttaaaaaaagcagacactctaaatatagccaaggtaatgatgtttgtaaaccaaaacaacaacag

SEQ ID NO: 1284 - DNA, 579 bp, Homo sapiens; identical to SEQ ID NO: 274

SEQ ID NO: 1285 - DNA, 1067 bp, Homo sapiens; identical to SEQ ID NO: 275

SEQ ID NO: 1286 - DNA, 485 bp, Homo sapiens; identical to SEQ ID NO: 276

SEQ ID NO: 1287 - DNA, 88 bp, Homo sapiens; identical to SEQ ID NO: 277

SEQ ID NO: 1288 - DNA, 64 bp, Homo sapiens; identical to SEQ ID NO: 278

SEQ ID NO: 1289 - DNA, 199 bp, Homo sapiens; identical to SEQ ID NO: 279

SEQ ID NO: 1290 - DNA, 52 bp, Homo sapiens; identical to SEQ ID NO: 280

SEQ ID NO: 1291 - DNA, 539 bp, Homo sapiens; identical to SEQ ID NO: 281

SEQ ID NO: 1292 - DNA, 502 bp, Homo sapiens; identical to SEQ ID NO: 282

SEQ ID NO: 1293 - DNA, 43 bp, Homo sapiens; identical to SEQ ID NO: 283

SEQ ID NO: 1294 - DNA, 1064 bp, Homo sapiens; identical to SEQ ID NO: 284

SEQ ID NO: 1295 - DNA, 582 bp, Homo sapiens; identical to SEQ ID NO: 285

SEQ ID NO: 1296 - DNA, 1483 bp, Homo sapiens; identical to SEQ ID NO: 286

SEQ ID NO: 1297 - DNA, 796 bp, Homo sapiens; identical to SEQ ID NO: 287

SEQ ID NO: 1298 - DNA, 233 bp, Homo sapiens; identical to SEQ ID NO: 288

SEQ ID NO: 1299 - DNA, 37 bp, Homo sapiens; identical to SEQ ID NO: 289

SEQ ID NO: 1300 - DNA, 693 bp, Homo sapiens; identical to SEQ ID NO: 290

SEQ ID NO: 1301 - DNA, 102 bp, Homo sapiens; identical to SEQ ID NO: 291

SEQ ID NO: 1302 - DNA, 422 bp, Homo sapiens; identical to SEQ ID NO: 292

SEQ ID NO: 1303 - DNA, 486 bp, Homo sapiens
ttgagatatacatgttataagattttatgcagtaaaacttatgaacacttttctttatagcatctaatgtgtgttccatgttaagatctttctcacttaaatcttcccaacttaaagattaagcatcaaacattatagaaagattaaagattatagaaacatcactcccccgattccttctgattcttctaaggtatcattttttggctccctatcctttatccacttgaaatgtatttttctcctcctcataaacaaacaaacaaatcaaaaatcacaaatacatattaaaaaatctaaacatctcaaaccccacacaaaacaaacaaattcaggtgttagaggaagagtaatagatgtgagtatggtttcttttcccgttattcaaatgacatccttttcaattactacaagtttataacagagagtgtgagcataagcattttaaaatctctagctttgggaatatgattcccaataatgtac

SEQ ID NO: 1304 - DNA, 1135 bp, Homo sapiens
ccaatgatcagtctcattgaataaaacttgaacctgtatttttattgtagaaaacacataaaaattttctcaattctcaagacacgcaattgatttaataacacttttttgtgcagggaatagagaagatgagaataaactatcacaaccaatgactaagaccatgaaaagtgtgcatttattatccaggtgtcagcaatttcttcctgagtaactttgcatgtgcagtgttgttctgtagaaaaatgcccagaggaagttgctggaaatctggagacccttcaagtgcaactcatgagacagacccgggtggggtgagcgctaagagtccttctgctccctgctgtgactccacctggctgtgccaatgagatcgaatctgagagtgtcttcatcttactaaactagccaaaagtgacatatttatatttgcggctcctatggcaaacctgagagtaattcttttattgacaaaataacatagtgtatatcacatatgggaattctctgtgtatgattctttacacagagcaaaagcatagcgaggctacacttagagatcattcaaaaggcctgcattccttttcgtgtttcttattaaagcaacatgaccagtagttaaaattaaacctccaaaaagggaaaaattccacgggctcctcacgtttaccccagacttcccatgcaaagctgcttggagacttaaaacaatgccacagtgttagagggaagtatttcaagctgttttaagtggaaagctgcatgtaataacatctctttcttctgatgattccaatggttctgcacgttcttaacattacacttatcctttaaaatgttaaaatgtctttacaaacacaaatgcccattcaataaaatatcatgtatatttaaatataatttcctcatgcaaaatattttacaccatgggcaaaattctgatgagatctacctttattctaaattatgtcttaagaaaatctattacacaattttatttttggaagctggatctctttaagaaactgtggaaaatcatgggtttccaattaatgcagccattgtgaaagtggcttttctgtattccactttgaaaatgtttttccttgtgtggtaaatatttttaataaaagtt

SEQ ID NO: 1305 - DNA, 582 bp, Homo sapiens
tctgttcaaatataattatcaacattcaattttaaaatttccataatgtgttaatgaccttacactattctcattttacatattaccctggtatttgaaagtatctgaatttagataaaaatgttagtcagaatccgaaggtttaatttttttcaaaaacacacttattgagggtattttttagagctaaacatatatttggagacaggccttaattctaaaaagcaggataaatgtctactttcctttccacatgacaataacatcaacatatatctaaagtatttctttacattttaaaaatttgcaattacgttttttgttagttggagtaacagaaaaataagtttattcattaaaatattttcactgtatttctgaaaagttgagatttattaataagtacaattcctcgtgcctattagattatctaagtatcagtgatgactttatctggcttgtcactgtcacactaattatcattaggtcagtttatttttgatattaagaatttttgccattttgttaatataaaatgtattcttacacatgggattttaaaagtgtttcaatcatgtatca

SEQ ID NO: 1306 - DNA, 263 bp, Homo sapiens
ccttgggctccactaaagattgagggtttccttgcaagtgttgcatactttaaagtgcttcccaaatactgtgcaagagccacacttcaaacatcaatattaacttctattatcattacaatgattgtggtagtgatcaaactgcctatgaattatcccttccctaattcctatgaaaatctgtcccattcctaagtaccatgttaccatatacttcataagctattcttgtactttaagagctgcaattaaaaacattatct

SEQ ID NO: 1307 - DNA, 111 bp, Homo sapiens
ttatcttacaaaaaataagactgaagaaaattccaagtagacaatagccttcctgagacatccacagatccttcaattggtaaatccaactagaacatacattttcattgt

SEQ ID NO: 1308 - DNA, 316 bp, Homo sapiens
atataaaaaaggtttttttgagatggagatgcatacagttgttataattagtccctaagcacaatttcaagttattatacactatggatttctgaggtagttgaaaacattctatattgaaaatactaagtccagcaataattcacattacatgctatgatttgtaggtgaaattaatgtacttgatttcaattagtgattaacttttaatacttttcatgtattaaaactactcggcttaacattaaataacactgatcaaatacaatggctgttttttacatttcattttgcacttaatattaaatttaaataa

SEQ ID NO: 1309 - DNA, 1541 bp, Homo sapiens
gacttatactggcactaatattaagcatactaagcatatgttcttttagttaaaacccataggcaaatataacatttcaattttcctgaaaaatctgttttaaaattgaacaagattgatacacattttacagtaaagcatttcaggaaaattgataatttaaaaaacagtgatgggattagatagagcacatgtgaaataagcaagtcaaaagttcttcctggatctaggacttgtgattaacttggtttgccagctttggtttctgacctgatgcagagaccccgttccactccctctttaagcactgaatcctgagctgtttatcttgacctccttgtgggcttcaatcattgtaaattttctctagaacaaatataaagtctttctagaaaggccaagactgcctccaggacaaagccaagaaaggcagcctcttccatggctaggattgtaccaggggaccaaaaccaggacaaaggaggcacagggtgtttcaatggcccaacataaaccttccatggttccacgatgtggaagtaactcaccaggaatggcaaccagaaacagctgtgtctatgtgctcaggaagaaaagaaaataattactggtcacttcattcagggagaaacccacaccattggtattccacattctctattccataagtaggcataattataggtacctccaaagttcaccctcccccagtgtcctctcctcttggctaattaagatttaaaatgaagacacaattacttatttgctatataacatgtttttctttttcaagagaaacacttctgtgaaatagggtttaagggtcaacaattatgcctgaagaatgcagaaggtgtcaagtaatacattttaatttttactcaaaaccttaaaagggcataagtccagaggggaaaatatgtattattctgttttcttataattcacctaacttaacagtttgactgcaattgagtggaagaggttcaatgccaaggaacccttctgtgtagtacagcccacccctcagaaagaacatttgtccctctcagcgggtagttacagcaagtgtgaggtctgccttgaatgtggattctctggtgccctcatgactgctgggcagccggtgacagtggtgaaggcaagcacctggctctcttcacacttggccttgtgtagccttcatcagtgcctgaatcccagttgctcttgtgtggatagagacatgttcacttgagacagggaattattgcaaatccatggacagatgctcccgctgcttggatgaggccatgctgacatcactcacccaagcacatcatgtggtcatgctagagtctcatgaactgttgatttgccccggcagagtcaggtaacaattgaatgaaaggagaagaatcctcctctcagacaacatgaagttgtttgaaggcagagcagcaaatgattggctggtcagtttaccttcagtttagtccggagaccatgagaagtatatgtgggcaaagaaggcaaaccacacataaaagagcagtctgtca

SEQ ID NO: 1310 - DNA, 230 bp, Homo sapiens
gacttacatctaggacagagggagactttgaatcccagccttcaacatagtgtgcagaaagtgtaaaagaccactcacaggcaatgccagctcagaaggacctgcatgaactgagtatagtattaaaacaggaaaggaactatcttgtgtcaaattcttattaagtaccagccccctaacatagcctctctctctttatctccaataacacactcctatggaaacagggt

SEQ ID NO: 1311 - DNA, 238 bp, Homo sapiens
taggcaagctgttttgcaaacatatgagaacagttatctccttaagaattcactggactatgcagcaaataaaaatcttaggagaagtccaggtgctcgtatttagaataactcaggtgcaggggtctggagccaagaagtggtggcagctcaagctttcctatggaattcttacataactttaaatttgagagctcaaaagcaggaggcctgtggagtagatattaaagaagaaaac

SEQ ID NO: 1312 - DNA, 739 bp, Homo sapiens
aagaaggaaactttttctttctgatatcctttagttgtgtttctcaactgaagtacaaacagttggtaatagattttcaaactttacccagctgactgttgaaaacacacattgccatttagagaccaaggacacattctctttgtaaagcagtttcacgtgttgatgggttcttacccaccctgcccagggtctgggggtgttaccttacgacaacactggaatacactgtgctccagcccaagcctaccttggaacccctcttatcatgtcttcctcactgtcctaattagcacttaccacttttgttagtgccagcaccaacaaaaactcggtgcatttactttctgccatttctctatttttaaaaacagatttaatggtggcatccatataatgttgctgtgctttattacatttttgttgtgtcatacagatgtcttcataggtgtcgcttaatggcttcagaataactcaatcagagaacaatcgttgaaaggatgtatcataagtggtgattaattcccttactactggaaattgaaaattagaacactggttatgatacagatatagctttaaaaaataattggagaggaacattaggtgaggagattaggtcctagtgtattccgggatcagactttaaagataaatcgattttggaataaattctaaggcaactccaaggtccttcggttcagttccatgacagcaggtgattttacttacaccagaa

SEQ ID NO: 1313 - DNA, 490 bp, Homo sapiens
aatataaaggaattaattacaaaaaatccacattctctagaggttaaaccaaagccagcacaaacaaaaactcaagactttgagatttggcaaatattaaattcattctgaggggataatatttactttgtaaaatgggtacatgtcaaaatgtcctcctgaatgtttatttgattaatgaccaaatgagtaaggttgtctggctgggagaccacgtggagaccctgcaatttctctgtacacattgtatgctttttccattggcagatgctgtctttagggaatatttaattaagaaaggtgtcaacctattaactccggcttttaaaactttgacctttagagcaataaacatcctgtagtaatctaattttccatactaattttttgatgaggtgttaatttctttaactaaatgatactattaaaggctaactgcattaagaacgcccaaataccagttcactcaatagaaccaatgtctttttcc

SEQ ID NO: 1314 - DNA, 139 bp, Homo sapiens
caatgtctttttcttaatggtccatctttccctctagtcttataaggcacaatttaaaaggtgtgactcttttatatgtaagctataatacttccagttcccagattttctctcctttcccccaattagttcattaagc

SEQ ID NO: 1315 - DNA, 637 bp, Homo sapiens
cccacctaaggcccaaaggctttcaatccttttgctactgtatgatattgccacatttttctgcaaaggaattttattttgtcacaagaattttgcttcctttcaaggtatgaagtaaattagcagataagggagaggcagaatgtccatttgctaatttaacaaatattatatttactgacccttttttgagctggataccaggctgggggcttcattgaactcagaagcacagaggaagcccaggctttgggagcttatgttcccacagcttgaatgaagcctgtgctggcatgcaggaatttacagtctactttctgttctatgataaaagattaagtgcacactctttcaatgaatgttaaataaaaaattaagattgtatgagtaagtatccaaagggtagaaaattccatggtgttcagaaaatattagggtacagattaacctatgtaatttaataactcatttgataaatgaaatacctaattttctaaattagtgttattaaggaacattcatttattcaaaaggtagatgataatctaacttaggggtcagcaaaccacacagcctgtggccaaattcatacggccacctaaacttttcctgaaacacagaactggggaatgttcct

SEQ ID NO: 1316 - DNA, 54 bp, Homo sapiens
atgctgatccactccacacagaggccttaaaatgactttaaaagtccacatcag

SEQ ID NO: 1317 - DNA, 344 bp, Homo sapiens
gagtccaaatcagcggccctcccatcaccacacctctaagctgttcttttcttagccttgaagaggtacaatcagtcacactacttggaaggctataacattttcttgtgggagaaaataacaacctgatttctagacaagattattagagcacaggtcctgtggctgctcttttcctcctgaattacagaggtgggaagcctatgagttcttggccagagctcatagggtagcaggttctgacttcgcattggtgtttacacaaggcaggaagtcagtgagtggctgctcttggctgctccatcctgtgcctcctcatggagactttttccactaaattaatt

SEQ ID NO: 1318 - DNA, 842 bp, Homo sapiens
ttttcccactttaaagaccacatgatgctactcgaccatgagccaggtgcatggcctggcccacaggatgaggtcagctttcctgtcttcccctgttactcatggtactcatagctgggccttcccagatccccaaattcctcagaaattagtgaatgtgaactcacttttgcaacttatacacagatgtggtcaataaggcctaaaatgaaaaaggatatgcatgaatagtgcagtttctctggtactctacatccccagagatcaccaccaattccaatgagttagctttgtcttttgaatgattttctcactctatctattaaatggctgtgctaaaaaaaaatgctaacatcaaaacacaatttttttactcgtctttgaggtcaaacttgacggaaatataattttgaaatattgatcttttaaaataactttctaaggcaacagtgctatgttctgatcagtcacaacacacgtgtggtcagtacaggcaggtgttctctcaccactcccaacccccgccgcctgaggtcccaggatctccttaagaataaccagggaatggagactcagcttagaaagctttggaaaaacagagtataaaacctccttcatgtttgcttgatccagtctgatggcaagcagaatgaggaagaggctaacgggaagggggttgagcctctctcagaagacctggcttctgcctgtctgggtactgaccagctctgcctctcagtttcacacatgaagagtgcaatccagcagctccttcagctgaaatctgaccactgaatgggtggtcctcgttgtaccggggcagcagaaacaaccagtaatac

SEQ ID NO: 1319 - DNA, 1666 bp, Homo sapiens
acataataatcccgccaaattctcacaaaatctagcatattgtcagatatgtgaaagaaatttgtgaaattgtatcagttatcatttatacacattttaataaatgtcattgtgcattgtctttggaaaaaagactcaagaaaattaaacatgtaaacatgatttagaaggagatgggtaatttagataagcagtttccctttttaaatacttcaagattcatttataagactggttttccaataataaatggcattactgagattctatgatggaaagtatattggcaaagaaattagtatccaatcgttacccaattgttttcctattcctatttagtgtacttctttaagcatctttctgaaagattaaaattgcttttgtcaaaaaaccccacaatttttccttataatttataaaaaatgtttgtgcagttatttttttttaaagattcttttctccatggaatgttaactagggagggtttcctatctttctacaggagtaggataatagagaaacacattggaaatattcagagaaatgcttgggttgaaatctttagttttcttttctcgaatgaaatactaaaggaccaggcaaaaactaaccccctctgaggaagggcacacagaagactatagtctatcagttgaaaatgaagttacgatttcttactgcttctctcagagtaaacagcaggatgattaagctccagctataaatgtcaagctccttccctctcaggagcccagtgaagacacaccagtgtcatcattctccttgaaaggaaagagggaacagtgaactcctccccaggcctctgtgcctggagcaccagctcctgtggatccacaagtgggctggcagttcaggtgcatgagagatgccagggacactgtgcctctcatcactgatctgatgcagaacttagttcctaagttgcgtgtacaagaggctgagcgattatgacccagactcaaggaaggagagcaacctgtaaaagatgaattgcctcatgctctgtaagccatgcactcccattctggcaccagaatcaccctgcagacagcacaggcctgcggcttcctgtgggttatcccgtgtcaccctccaaaaaggtcatccttcactgagctggagttgaaagactggtgtccttctagatatattccagctatgacatcctgttggccagaccccaatcctgttacccactgaaccaacagcaactggaggaagaataattccttccctaggctagttctgcagggaacacaaaccagaacacatttcaagcagccagtggttaaatttaggaagtaagcatatataagaatggcagttaataaataccactagctgttattaatgttcacaatatcattatgattagctgggaggttcctggcattattcctcaactctctctctcatttcaaaggagacattaaagacttcattttctagaatcatcttgacaggcttattgctgtgattacacatcaaaaccttccttccacctaagaatactcactttgcagagtgcttaaattttatactctatatattatcctatttgagtctacagcaattcacatgtgttgagtgacaaagtgaattctgaaatacttttgcgacctgggtcaagaaacagcaacaacag

SEQ ID NO: 1320 - DNA, 700 bp, Homo sapiens
ggcaacaacaggtctgttccatgaaccctagcttctgagttccaaagccagtgtaacttggcaccttgtttagagagagagtggcctgtgtagggtagatgtctgtgagtgatatatcaaaaaggactatttctactccaaatctgcaattacaccctgctttaggagtggaattaaacaagatgcctaagaacatttaagattctgatttccccaagggcgatcttttgtcagggatcagagtgtatatacaatctcccggagtaaagtgctggtcaggtgtgtgatgtatacagtactttttcatttcctaagtacctgggccaacatgtttccaaattaaactttaaacacaactgtggttgatcgtggatgtcccacggaagataagactggcctgagggtgaaggaagatgcaatgactcttgggtttccctgtggctggagacctccctccctaccctctctgcaggctcaggagagaagcagcactccaggggagctggtgccaaggacagtggcgggggaggggggggtgtcccggaaagtgggtgccactgcagcaacatcaaccactccttcttctcaaggggttatcagcatatgagctgtggtcgagaaggacgtataccttataatattttttgttatttctatattcaaataaaatacaagcttgaggccaggtgcagtagctcaa

SEQ ID NO: 1321 - DNA, 647 bp, Homo sapiens
agcttgtgccagattaacatattaatacagtcatcaaatatcagtattaccactgagtgttctaaggcactgaataatttattttaaccctgacaacttcttacaggtattataacgtggctcctcctctgaggagaactggtgggttattctcatcacagtgaatctattttaatgaaagctctgcatcctagagcacaggactctcagaggcatgaagggtggctctgaggccattcaacttcagggcatctgaagcctccctggctctctctgggtgggcccttcacacacacaccagtgcatcctgaccccggagatgccctacctgcgtgtgcggtagaactggcacctcttcagggggatcttgaccacgtgctcccgcaggcccacgaacaggacactctggctgtgcaggatctgcaggctcctgatgggctccctccgcctctcagggaagagctcaatctcttccagcaaacagctgcttgaggtctgattcaggggtacccgcactttcttaatggttccgtaatctatgaaggtcacaggatgaaaaggaaacaaggtcagagggtctcacaaaccaatccctggttaaacagagtgtgctgtgtatgcagccatggatcttcagccaggaaagc

SEQ ID NO: 1322 - DNA, 1230 bp, Homo sapiens
atcatgtccgattggacccttccagttccaagtctcgggatggagagctcaaagtagcaagctttgtgccatcccatggaaaacatcaggaaagaaagaccctcaagggacgatcttggattcttagtgacagagatgctgattttggtgcccagcagggcaaggaaaatgcaatgtgattggcagcttcaaatatccagtacgactgtgatgccccctcctccttcctgccacgagaagtacaccctcctccatctccctctctcctctgtctacattagctccttctttcctcctagtgcttgctctttgggatgattttcttgggctcaactcctccaaactttctttcttgtgcttctgagtattaatttctggcctgatccaagccctccccgctccaggcttcttgctccctgggtgtttctgtgcacttatttatctgcttgactgctagcactgctggagggtgagcggcccctgagccatgcagccttcccagcttagggggacacacagttgaaacgaacattgctctcccaggtaccctgtgctgcaccccgcaactccttgctgacaccctgcaaatcccaggcatgaaatccagccttctggaagccgcttagagatccactcaagtacctggaatcatcctgaaggccctgactgaataaaaccttccatgatcccgagtttcaaaacatcatggttcttattttgcaaacacagaaaatgagtttaaggagttattctaaaaccagaagtagtcaagaatatttgacttcaaggcctcctatcaagcaattcattgcaaaagaccttggataaaatactttacatttttctctctctatgaaagccatagagatggaggctatttgtgtttaaaaaaatacataagcagacatgttttagcctgaatttactttaaaaagcatatctgaaacatctccagtgagcattttctgattatacactgactgaaaaatcatgtagacagtattggcaaacaattgcttgctttcattttaagctaactggttaaatatgctactttttaaaaaggtcaatcatacactgaagtatgctatatgcggggaagattttaaaatgatcttgaggaaagagcatgtatttgtgttcatgtaaaagggtgaggacaaaagagagaacgagagagggaagagaaaggggcagctgtggcgtagagaggcagacattttagcaaat

SEQ ID NO: 1323 - DNA, 2547 bp, Homo sapiens
cttcagggaaggtgacatcagctcacatgtgtcagccacaggccctgcaaggaggtccccatgaggcaccagcagagggaggtgtcagccttcctgtggagcagtgatgggcatagagcctgtggctgcctttgcgacatcattacacaagaggacatcatctgagacacatgttaggagggaggcaggggaagcaaggctcatgggagaacttatgtgagagacccctgggtgaaacaggagctttcatagaagttcaggggtgggtggcctgcctagagtcaggatccagctggaggatcactgtgctgtgaccagcgtcacactagttgttcaccagcctagagtggcatgggaaacagagtttacagaactatagcctatctgagaatttaacaaagactcattgctgtttattatttattttgttgaaggattatgattctgagaaacctgcccaaattaacaacagtccaaatgtcaatatgctcatatgtatttcaaattcttaagtaattgtggaaagaatcaaatttttaaagatctgtgatagtttgacttaaaagagtgagccatctttgatcataaacttttactgcatatttctgcataccttgtatctgattttccaactagtgggaactaacaaaactacagggcttagcatttcagagcaaagtgctcagcgtgggcttgcatgctggtccacaatggatgaccgtgcatccttcactccctggagtgtctagtcatgtgacgagtcccctccacagttcccccttccctctgcatcaggtttagcacacaaagacccttcctgtctccttgaagctcttccttcccctgcctgtgccctgcccttgttctgaactcctgcatgctcacatgtttggtcacagccttctcatcccctgtcctcatgattaccctagggtctgtcttcaaagccgggatctgtcttcaaagctgaatgttggctctgtatctgcaactcaaccgttagggactggagacaccagaaacttgacaggcctccctgactctccatgtggcctaccagcatgtcccacctcctgtgaccttgtctaagggacagcagcaccataatcccagggccgatgatgggacctctccttccctgtcacccacagctcacctagttctcgtccacccgcccctgtcatccctgccactcctgcagcttcctctacacctctgtcacccacatctcactgcatctagaggcaggctccaggcatgcacatggtggccccatgctccttcatgcctccatccttgcctgtgcctctctgtgctctggcaacggccaccaggaagcacttgcagcccaagagcctgtgattgtggcataccctggacatgcagctcctttgcctgaggtgacaaatgacaatgttattttctttcagtggcagaaagacagagatggccctatagaagagacaccccgaaaaaccccatagatttctatttgacataggaggacaatagcaggaccctggtggatcttgcaaagctatttgtatttggttgctgtttttactttacaacatttaccatggttttagttactaacttacttgttttgtggtttttacacttgatcttaggctccatagggaaaagaactatgtcagttgtgtcatatgatgtatgtgtagtggctgctattagggccagtagagattagatgtttcatgaatatattctgctgaaagactgaacaaatgagtgagggaaagaagtgtagccagcctggaatgagaatgtcattattactcccacatttgctaaagagcgctgattaatatttttcccattataatctctagcaggagttatgatattagtcagtgtgaaggtgaaacaacaaacatgaatttcaccaatatggaaagatttcaacccaagatgtcataaactaaatatgaatgaagaattggtttcatccaagaaaatattaactccgaaaatttgccacaagaaataaagccatacaaaacttctatacttctgaaatttaatactctaaccaaagttatttgcatgaaaaaaagtgccagaaatatgtaaaatcttcttaatcattctttaacattcagagatcaacaagtaaaaaaaaaaaaaaaataggcatttcctgtccatttcagttccccttcccaaggagagacgacaatgtgaggtggagctgcagaatcagtgctgaccagaggatgctcagaatggacactgcttcagtgcaaactctcatagtatttgccatttgtgaaaatgtcccctactcattatgctatggacacaaatctgagtgtcatctatttatagtttctctctcaaatagaaaactatagatactcatcatgaaagggacagagctacttcaagactttaaatatccattagtgttgatatggttattattcaaaagacacaaatacttgtaattacatgaaaacatcattaaatattatacttcactacatatttgtctcatcttagcagaagagaagggatgttatattc

SEQ ID NO: 1324 - DNA, 268 bp, Homo sapiens
acagaactgatacatattttctatgaactggttagacatgaaatgccttttcacttcaatgttgatgaatgaaataaaggattataacaatggactccacagtgaacattaattataaggctattactgaggatacagactgaaacaggggaagaggtagttgtgctttgattgcattgtcctttttttctatccgctcttctagaagtcatagaacttagccaactggagggcaatgaaaagaaagtcagtattctaatgaatgctg

SEQ ID NO: 1325 - DNA, 111 bp, Homo sapiens
aagtcagcattctcctccattggaagactttgtctgtcatccatctcaaggacaagcagaggcacatctgtgtcagaaggcaatatgttcttctggcctcaatgaccccct

SEQ ID NO: 1326 - DNA, 681 bp, Homo sapiens
gggtaaccacaaaaagagaagactttctacttgttgttccaagtatacattttacactaaaccctatgctatttagagagatattggtaaaaaattatggcagtgggtcatcagatgaggaattccctctcaaaacccttctagataaactgactctcaattcccccaacctttactcaagaaattggattttatgtgctccatccttttaccctaaaactcattagtacataaatgaggagaaaaagttgagaattggagaggtgggaggtcagggaagatagagggtcactgggggagtggactgtccactctaacccgtttctgatcactggtatccacagaatgaaccccaaagccatcgcccatcaaagggcaggtcccacacttcccagcaattagatccaggtggaggtgagcctctggtggggtggtgcggaagggcagagccaggtaaccagggtagtcagggcatgcctacctcgcccctaccccagagcctctcacctgcaaactgggtacaagcagttggtgtaaggtcaggaatgttgtcaaaggcaacatgaaagttatagtgtatcaagttcaagacctggacttcacagatttatggctacataaatacacacaatgtctttatgaatttgcccctgcttttaatttagtaagagaccttcaaag

SEQ ID NO: 1327 - DNA, 902 bp, Homo sapiens
ctttacactgaaaaaaagagagatggaatttaggtagcattatgttctgtaagtagaaaagaaattggtaagaccagaatctcttaccactgaaatgtttctcagctgctaaaatagggagcctggtacactcattgaacagctttctaattttcttttatatcctacacagattttctctttattctgccatgcagaaaaataagagaggccatttatagcaaccatttgaattctctcctgtattattttaagatgctgctgcttttacattttgcccataagaagttttactagaataaataaaaccagttgtacacaattcacagacaattgttttccaaaggatttttttagtattataagctgtaacctctaattaaatatgtgatcccactggattttatacatagaatatagttaccatatttacgtgtgcacattatccactttactaacttttctaaaatttctcacataaatctgaatttttaagccttaagtgggatcccaatttgtacatttttctttcaactatccatatcttttgatagtgaatagaccagtcctcagttactccttagcacctcctatatttgcaatgcaggacccagtgattacttctattacttctggtagttctcaaagttacaaggaacaagaatgatcatgaaggttcaattcacctgattccataatcacattctttgctcttgagacattcgccccgttacttctgtgccttgtctttatcaccacaaatcctccgatcagcacatcccttgcctatcagcctctctacttaacaacttcatttttacatttattacatctttcctgccagagtcagtttggactactataataaattaccatacaccaagtggcttgaacaagagaaa

SEQ ID NO: 1328 - DNA, 231 bp, Homo sapiens
tccataacacttcctatatgcaaagcagagcaaaataaaggcaaatactacattttcaaagttatttgcctcagtagcatcagcatttggttccagctgtaatcctcagccccctcccatgatggtaatcaaaggcttgccatttgctggaaattcctgccctgcaataggagtgttcttcaccctctacatctgacaactgccctccacagttcacaaatactgacggcg

SEQ ID NO: 1329 - DNA, 158 bp, Homo sapiens
ggagagtaatcaaattgtactacatatactcctggtgctgatgaggaccagtaatgagacagatagaatgtatccagagacatctgttggtgctaagaagggctcaggcaggtaataggcatcctaaccatttaggacaaagtaaaggacaaataaat

SEQ ID NO: 1330 - DNA, 997 bp, Homo sapiens
agaaaatgttttggccagagtgtgtgcctcacttagaaaggaaggggaaagatagaggaagggcagtgcaaagtcatgttcaatggtcatggtcagtgaggcaaaactgcatctctgagctcaggatgaaagaggatgaggcaacgatggtcgaggatgctgattacatctcctaagtacaggttttaaacatgcacacatctggtcaacctcttctgattgtgtgcaaacctaaggagtcacaggtgggccctgataaggtcatgagataaaatagggggctttatgtttcctagggcatgcatgcacacacaagtacatggcagatttaacattttataaatgacacccaaataactcctgtttatcatctgggagcattccatttttttctcaagaatcattgtatgacaagatatggcaaagctcaaattaaatcaacacaacgaataaccaacaaaaacaagtgaagtttcagaagggcaaattaagaacaacttttgtttttctgtggtgtcacacagagaaaagttatgtctagagtagatactctttgatgtacatcccaaaagctctattagcacatctgcagccaaaccactggtttcaggatgtgtactgttgggcccctcggtggccatattggttccagatggagttcaaataacataagggcctttgttcccgggctgaactatttcatttctccactggtaacttgcacacatgatggagcgctccatcatgaacgatgtgcaatgcccaggggtgcttcaaaaaatgtaccacagagactgctaaaactcatggaagcccctgcttttaagtgatagcagcagcatttgccaacagagtggtgctagtgggctgtattacattccatctttgtttatgcaacacccctggaataaaaagttaggcatttaccattataatttaccttaattatagtatttgtcactacctgtaatgcacaaaagaattatggtagttgcac

SEQ ID NO: 1331 - DNA, 306 bp, Homo sapiens
tcctatgctggagagaaggggaaatattaaataccttacatcaaatacctaagggcagacttaaggatttctaatccactgctgctgactgctggtattttaagacgggaactttcaaagaagaatgaatgttgtcagaaacatgattcctaacataaggaagcaatgactgggggctgggagatggcctatatcccttgtaagagtattttgagccctttagacaataggaaggctctctgacagtcttacttgtcaccaggcctctgctatgtccagaacaacagggttagaattcatggcccc

SEQ ID NO: 1332 - DNA, 426 bp, Homo sapiens
ttcatggccacatttccaaaatcttcatacttttgcaagctcactgcctatttcagggccatttctttgaacttatttcttcccctacccacataatcagtgtgaacagtctagtgtactgccttctgtatcttcctccatgtttctgcaataacatacaaatacaggtattcagacatgggggatggaggtcattttactttataatttgagattttctcataatatcataaaatctctccaagttaaccaggtatgattaaaattaatctttaatcacatctgagacattcttacaacataactgacatataatctatacttgattggtacacattcaatatgtgagatcaatttttgggagagaggaaaggaagcagtaaaaaagcttctataaacattcactatacatgcccttatatatgt

SEQ ID NO: 1333 - DNA, 2544 bp, Homo sapiens
tatctaatgttagactttttagatggtttatgtcatcttttagcacagtttagtttaacgataaccaaattacagtctatcccttaagttgccaaaaagaaggaatcagcagaaaattctcgttctgcaattactaagataaaacatccagtgaaagaggaacttggaaaagatccagtacaaataaaactgcatgttcaagaatgctttcttaacctttggcacagatgccaccttgccccctccttggcttataagaagctgtcatacaccatcattaacacagttggtctcacccttcaatgcagatgttatagggtgctgctcctgaataattcttcaacctgggcaacgcatttaaattgggaattttcagctataattgttactctctgctgtccataggatgaagtctttgacccgaacctaaatacagaccagaattctgagcccaaaaactatctccagcatccggagaagaagcatcatgaaaggggaggagagagctgtttatatataaaataagttgaatttgcaagaaagaaccgactgtctttttctttaaaaattgtaggtagtatcaaagtttttctcctctttacagataaaaacaaaaaggctaacggaatgcagtcgaccgagaactagtttcttacatttccattgagggtatctttctctagatctgtcatttttcagaattttccaagtaataaagtcacaggcttttttgttaggtggctggaaagagaaatgtatttgtcattctgtctgatcttccaaagcatttttcagtgttgtttttgttgctgttatcttgttgaattttttatcagactattattggtatcaccaataaagaggatgttgaattatgtttctcattccaaaaatagtgcaaaaaaattaatcttaaaaagtataatggaatccacttttctttcactgactccatctgcaagccaggatcaactgtaaaatcattttatgaagaagcaatattgcaggggatttattctctgggtctaacagactgcttgcaagccagcgttaaagaccttgaacagttgatgcaaattccacctttgtattttactgccctcagtgagctcaacatcattcattaaagggtgtattagctgatatcttaccaccgccatgcagcagagaaggagaatcacataattttaaaattcaggctgagggccactgtggacgcagaaggctgacttccgaccacctgcttccccactagacttgttccaaatggctttcttgagaggtgattcacaagtgctaaaaaatcacgaatttttaaagtgagatattttggattacttataaactactttccgtaatggcattttaccaatgaaatgatccactggatgaaaatgacttatccttagttatctgttttattcctgagctcatctattttgacaagttcttgatcattgtgcagtacaaactatgcgcagccttttcacaaaggcttccctatggattctaggagctcacaacccaccgcttctcaacagacagtcatatattctactttacagcagaatacttctgcctcagggaatcctaatggccagtgccaaatcttgttttcactaactgtgagaaatgtgagccttatgctttacattaataggccaaatgtatttctctttgatagaaaatcaaacttctaagccactgataaaactctggtgacatcctgagcttcacaggtttgatcctcttacaaaaggtgtgaacaatgcaagtgaggttaacaaaaatccttgcagggaatcacacactgagtggctctctggcctgcatcactaactgctgcattttattaacagcaggtcaaagagcctctcgcccaacacatcacaaatgttcacagagattcaatgagtcaacaagtatgcctactgcagctggaactgacactgaaaatgtgaactacattgacaaaaattctcagcaggcctctcaaacacaaacttttccctagcccaaggtctctggggaaaaattataacaattaaaagtgcagtgtggagtgagaacacagtgcagcaaatttttaatgtcagaaagtagcaatttgataactaagaaaactggaaaaatcattataacctatgccttactttgcccagcacctcccaagactcaactggaaagagcctggctttgagaagaatgaaagcctgaactgctgattgtgagaaaaaaaaaggcaaaataagtgctgaaaggaactcacatcaaatatttcattgtaagagtctgatcttatttcctatagccagaatggcatttgacgatacaacagtggagaattttgctactaagatgttgaatgaaatccctcaagaggagaattacctttgagattttctgtcacttttaagatcacttctgaagtatcaaagcactactatagcaaatgaaatattatgaggagctttgcaacagatgccaataccttcccaaacatgtctgaggcatctcctaggtcagaggccctggatttcaaac

SEQ ID NO: 1334 - DNA, 513 bp, Homo sapiens
cacacacacacacaaatacctggggaggagggagaatgcaagttatttctcatggtcactttgactgcaattttcaagaaaagcagtcagtgtgtgacagcaacagtagaagcacgatttccaatcagacattaattgagacgaccactagcccttggtgaccccatgtacaggaagagatgtttcagggacaccatttgtttatacagatgtctgtccttaagggatttttgtttgaaatcaaccaccaatcatgtattttctgcaaggaaattacacagtaagggtgggttccaaccctcaaaatatttgctagctcagtgaaataaaaccaagattccatttggagaaacctatagctgctttactttgcaataaattgtaaaataggtgggttttattgttttataattcttttctgtaatagtctaccaagaggaatcccttggggacctttagaaaataaaaggggtaaaacacatgctgcattaagaagttatatattatccactg

SEQ ID NO: 1335 - DNA, 96 bp, Homo sapiens
aagcattatgaattatcaccaagttattagcagtgcttcaaaaaatatttcagatttggaaatgttggaaaatccacattattaaatttgtattgt

SEQ ID NO: 1336 - DNA, 551 bp, Homo sapiens
tgtgtattgtcattgctacattacaaggaactgtttaatgacttgctctgagcatgttcaagtgctcctttggctgcaaacacagatgactaccgcaggcccgtggaggtgacccaggattagctacactctattctttctacacttggggaactggcatgtgcttaagaaaagacaagaaaagctacttcaaatcaataaagtcttcacaaatcatgcacacgtgattagaaatgttcgttctgggtgtatctgatcatttagtaattgctcaagaaaacaagaataactttgtacattatctgccataaagacaaaaaatgagcaagaaaatgagagtcaaagttagaaaacaaacaaaacacttaatattataatcagagaactgagtcacactgtcataattcacttttttattgttgctaatattatgatgtcccagaagacacttctaagacatttacatagaccttaacacctggtttataaaataatattaaaagaatatagtccagtacataaaagagaaagttattttaaaaaatgaaatt

SEQ ID NO: 1337 - DNA, 745 bp, Homo sapiens
gggggggaaaaagatgaaatcaactcctagaaaatactgcagcagaatgataaagtaaacatacaactacatatcaagttgagtcgagaagaaaggaatttcaggaaaatacacaaaaatgatagtggcttgggagaaaagaatagacctgcctatcaaagcatgtgttggttctctgatgaggtttcagcctgagaactaacatgggaaatgtgctgtccttctcctgctttactaaccttctgccttcttggttggtgcatccctgtgccgggctgatgaatacatcacaactgctgctcacagctgggaacacaaccagtaataaggcacagttatagcttcagggatgtaaggaaggtgagtgactgtccatactgtgcgtgtgtgtatccacagtcacacatgtgtatgtagcaccaagttagtgaaaaggttttatttaaaaggtgctacctaggttgtgattttcctctagtaggtggatccttgagcagcctacccctaatttgccacaaattcataattaagttacatagctgggtgttagtatactgttttacatatagatttcagagattttaaccctgccttagtgcacctaatgcagtagggtttcatccaattataaggctttctctatctgtttctatatctatttatctatctctatataatttacatacatgcatttatataggtggatattctatctttctgtttattcaactctatctacatatat

SEQ ID NO: 1338 - DNA, 539 bp, Homo sapiens
caattgacccagaattgtggtcacagcaaggcagatactcttaaacattagtgctgtcctctggacatgtacatccagataactatgttacaggaaatacaatttcagtcttctgagcttggctcaccccacaacctgacagtcatgctgtgctgcgctatttttatgtttaatatgtactccttgaagatgatactatgaaattccactgtaacactgatagtgttcaaatgctcactttaagaaaggttagatgccaggaaggaagtgataccgaatcctacagtgcaggaaagcagctacattggtttcggtcttggtgctatttgaatacctcaccttccttttctgttctcttctacatctcatagataaccattaataagaaacggactttagaaggatctcacagtctttcctgtctttggtacactgtaagtgatgttcaattacactggaaaacagtgaagactatttgagaaagcagtaaaatgaatggccccagctggacaatatggggacagtctataatggctaca

SEQ ID NO: 1339 - DNA, 116 bp, Homo sapiens
gcaataaacttcttaaactaaatatagcacaatcagaaggctagagcagtacatttaatcacactcttaaggaccattagagaagttatattttacaaaatttccatctgaatcac

SEQ ID NO: 1340 - DNA, 171 bp, Homo sapiens
aatgcatgaatctctgattggggtgggggaggaagaatcccattcctcttctcttagccaagcccatagccttccagctctgtgtccaaattagaaatagggtattactcatgcgattcagaaagtcccagaaaaatccatccatcaacccatctacacaacaaataatta

SEQ ID NO: 1341 - DNA, 2531 bp, Homo sapiens
gagcaaaggaatgggatacagtttggccaaactagggttaagagtttccatcagaattaatcagtgtccactagctggaatattgtgattggcccacttgggtaggtacctcacctttaaaacatcactgtagtaaggaggtggcctgcaatgaagaaaagaggaacagttctcaaaaagtatgtggcccctgagctgtgataagggtaccccaatttatatgtactaaaaaaaatctgagctacagtaaacaacttagatcaacccacttaattcctcagcactggaaatgtaagtgcactattcttagatactgttacatgaaaatgtggtgatatttacttcccagaatctcccaaccaacttcccaacctttgctttttctgctttggtttaaccaatagtggttactgctcaggctttaaacaaaaacaaatgaagcaaaatgactctgatttctttgtggcctcggaggctcaaaaagacacaaacacacatgaaacccccactagctttcctagataaagcatgaactgattaggtttgcagccctgcagctatagaggcctctccaatactctgatctggaaaccacagggcaggaaaatccccaaagtcccatgaaatccaaagatccaaacgtggggtcgtttttatgccctcaggaaagttctgccaaaaaaagagatcttacacacagtgtaattgagagggcagtatccttacgtgcacatgtaaatccaaatccaagcaattaaccccacacacatctgcccctctaatgggtgtctgagaataaacagcacacgtcaatccctcccagcctcactcaatcacgaaactaagaaaagaaaatgaattctgaacttcaccacacagctgtgattcacaaatatttatagtagccataaagctggtgaccttcaggaagataacacacttggcagacattcacctaaacaaaagaggggaaaaggcccaaatctcaaacagcagagaacagagagagaggcaagatttcccaagttccataatggggaattccaatgcattctgatggagataatggaagctgacaattctcctgtcagtgagctttggtaagcggagtgaaatgcttgtgacaaaacagatcagctctgcacgggcctttctggatggcctcacagagattttccatcaggctgagtacacaatcggatgggactcaggagtggtgtctacagccctgtatttctgacattattaggaatgacaggctaaacctttatcccaaattacaaccactcagcatgtttaagcaagtgtgtaccttgtatcaacaatatacatagagatgccctgaaaatatcacaaaataaaattcctttcaggaacgtggcaccgaaagaaacaccgtcagcaactcagcaagcactttttttttcatatttggtctctttgtctagtttaaacccctcattacctattatcacacccaaacctatgtcttctcactttccttattttatagccaagaaatctaacaaaatcaagacaagtaaagactgagagctgactcttggtccgatctgtccacggtcaggtggttatgaatctcaaaaagcgagatctagattcaatcttttggaactcctgcccttaacattattgtacgcacatcacaacaaattactattttacatcagtgctcgagactgcacaaacgaggacatcttatttgtgatttgaccagccttaacttggtctttgatacccaccatgtaacatttaatgcaaacaccttaagttagctacaagaatgagccaagaagcaaagcactgtgatcaggatttaatcatggttaatataatgggttaagttctataaaattttttaaaaatgaaatatagttgttaaaatatagtcataggttatataaaatcttaaaatagaaagttcccttctccctaacgaagaatgaataaaagaatgagaaaatttaagttgtctggttctaaactaggtctctatttgtagaaaggagaagtgtgtttctgggattttctcccacttgtacaaatattgttattgtccgaacatccacaataaattaaaattggggattgatttttttcagtgaggacaaagaaaggcagaataaaacattgagaaggttttaaaaagcaaaactatattttaaatatctgttcctgaattaaacagttaaatatttttaatacaatcagaagaaagtaaagaatttttgttcatttttttactattcccattttatagatgaaaatgttttgttttattcctaagcactgattaaaatcattatcaagaaaaaatctgacatcactaaaataaacttatttaaatttaaaaggataaagcaaacaagcaaatgaaatagcggaaaaaacagtgacaataatgagttaatattcttaataattaagccttaaaatctgtaagaaaaatgttgagtctctatagctaaacagttataaaatctggacaaataattctcacacacgcttgtttg

SEQ ID NO: 1342 - DNA, 63 bp, Homo sapiens
acctcttctcagagtaatggctaattattgcttgaaaaaaaattagcaaagaaacacaatgag

SEQ ID NO: 1343 - DNA, 343 bp, Homo sapiens
caaattgactaaaacaattaataatactactcaaagtttttgagtaatgatattcaaatttgttttagcaaaataaattctccagcatataaatgaagtataaatatctacaatacttttacaaagccaactggcagatttttaagactccctgggttttatgtagtaaatcaaccatagctcttctgagctaatgaattaaccctcaattaaaagaaagtattacaataacaattgctattgtttttgaagcatgtacttcatgcaccaaatacagtgacctgctcaaaatgagaaagcaggattggaactcaggtgtatgaagtctcccatcacccttttc

SEQ ID NO: 1344 - DNA, 133 bp, Homo sapiens
ctgcttatcaaaaatattccataaaagactacattaaatgtcgtctgtgattgtcttcaatagaggcattatagttgaattttcctcttcttttatatattttcagtaatgagcattcactacattaatgcac

SEQ ID NO: 1345 - DNA, 1144 bp, Homo sapiens
ctcctgaaaatcttactgaccacatggatgataaagtgcaaacacctgtactccagagataatctctgtttagagtatggtatatattaatatatattctaggagactttataatacacatgaacttgtgcatagagattgtgtgtgtgagtctgtgtttatttttaagaggaatgggattatattaaatatattattctgcaatttgctttctcagttaataaggaatcaaggatagttttccattacttttatggtcagaatttcattttttatatcattgctattaaggtgaagcacactttgccatggcacatggaataagtacctaggggccagtgctccttgacaaaggcatgtctccaaaacttctgctatattatcaggctcttgagtttgctgcaattatagatttctaagaatgaacgaatgaatgagtacaatagttccttgcttaaattgcttaaagaaacacaaattaattggtctttcaattttctttgcccatctttgtaaatgatatagtagagagtcaaatatgcctttaagtatcagaagtatccgtttgtaataaaaaagaaaaatttaaaaaatcataccacaatttatttatgtggcaaagggtattgccatgttatttcatcatttaactatgtcaatcctgttcaaactccatctttgctcataataaaagagggatattcgagaccagaccagaacattcttgttcaacaaaattatcagaaggcccaagataattgcatgtttaccctaatatatataaaaggcagtatgtataagggtgcaaactaacagtgtcacattcagaaactatataaaaaccaaagtaggaaataccatctaaacttatttcataaatgagttatatataccagcttaacaaaatgtcaagaaaataatatttaccaggccctaatttgagcaaagctgtaatttaggtgggacttagactaacacatttggggcatataaaccatgtcaagcaatagaacatcaaatgtccttattctaaggggtaaggtttgcagttacaatagacttcaataaaatttgtttataattaaaatccaagcatccaagataaattgcactgtgggactaatacctactgtccccgaaacac

SEQ ID NO: 1346 - DNA, 24 bp, Homo sapiens
aatcatagctcagaaagctgctta

SEQ ID NO: 1347 - DNA, 114 bp, Homo sapiens
atttagattactgtttgaaaaactgatttcttaatatttgttctgagtttctctctacaggtctgagtaactccagtaaggaataaaaactaaaatatgactgttcttattcta

SEQ ID NO: 1348 - DNA, 947 bp, Homo sapiens
tcctatcatatatcatgataaccgctgaccatccaaagcaagccaacacaggctccatgtggtcattcttccagctctcaggtgctgtggttctccatgggggagggaacgggaggttccggttaagacactatgtgaacctgaatctacgtgggctggagaaagatacaaaatgcagacctccgtttcttcttctgcaaaacgtaaggacgacacaggagaacctctcgtctcagctgagcacatctacacatctatacagagggcccagctctaagacccatttagcctccttcctcatagacgaagccagggactggtaactcataatccaagagcaggaatggtcaccaattattcagaaaatctctggattatctaaaatcagcaaagtgttttgtgaatggggaaaaaatataagcctgtccacaatgagacggtaatttagttagggagaaaaataaataagttaataaacaatggtagtgtctttgcagtgactagtatatggaatgaaattgtcactttctctcactttacttgttcctcccctacacaactagtcctctatcccccttcaccccttcctctcttctagccttcccagaaggtagcaacacctaggtctaaagtgcttcagaaaggctcctgtgaagccagcatttctgagccagcctttggaagatccaaacaagcacgattcgtggtgggaacagatcattgtgaagtggggggtcagtccctacactgtcccagggccacaggaaggaggaaattgtgtggaggcctgaccaggaggatccctgagagtatcatgagaggtttagggcttacccagcaggtacaggggactgcagaaggtcccaggacaggaagtgagatgacagtggtatgcactgcaaataagtgggggcagcgcacagaggtaactgcaggagacaaaactg

SEQ ID NO: 1349 - DNA, 1258 bp, Homo sapiens; identical to SEQ ID NO: 293

SEQ ID NO: 1350 - DNA, 130 bp, Homo sapiens; identical to SEQ ID NO: 294

SEQ ID NO: 1351 - DNA, 651 bp, Homo sapiens; identical to SEQ ID NO: 295

SEQ ID NO: 1352 - DNA, 284 bp, Homo sapiens; identical to SEQ ID NO: 296

SEQ ID NO: 1353 - DNA, 63 bp, Homo sapiens; identical to SEQ ID NO: 297

SEQ ID NO: 1354 - DNA, 812 bp, Homo sapiens; identical to SEQ ID NO: 298

SEQ ID NO: 1355 - DNA, 54 bp, Homo sapiens; identical to SEQ ID NO: 299

SEQ ID NO: 1356 - DNA, 191 bp, Homo sapiens; identical to SEQ ID NO: 300

SEQ ID NO: 1357 - DNA, 154 bp, Homo sapiens; identical to SEQ ID NO: 301

SEQ ID NO: 1358 - DNA, 1665 bp, Homo sapiens; identical to SEQ ID NO: 302

SEQ ID NO: 1359 - DNA, 51 bp, Homo sapiens; identical to SEQ ID NO: 303

SEQ ID NO: 1360 - DNA, 21 bp, Homo sapiens
taaatatatatacatataaat

SEQ ID NO: 1361 - DNA, 77 bp, Homo sapiens; identical to SEQ ID NO: 305

SEQ ID NO: 1362 - DNA, 55 bp, Homo sapiens; identical to SEQ ID NO: 306

SEQ ID NO: 1363 - DNA, 219 bp, Homo sapiens; identical to SEQ ID NO: 307

SEQ ID NO: 1364 - DNA, 1993 bp, Homo sapiens; identical to SEQ ID NO: 308

SEQ ID NO: 1365 - DNA, 374 bp, Homo sapiens; identical to SEQ ID NO: 309

SEQ ID NO: 1366 - DNA, 395 bp, Homo sapiens; identical to SEQ ID NO: 310

SEQ ID NO: 1367 - DNA, 1736 bp, Homo sapiens; identical to SEQ ID NO: 311

SEQ ID NO: 1368 - DNA, 693 bp, Homo sapiens; identical to SEQ ID NO: 312

SEQ ID NO: 1369 - DNA, 165 bp, Homo sapiens; identical to SEQ ID NO: 313

SEQ ID NO: 1370 - DNA, 269 bp, Homo sapiens; identical to SEQ ID NO: 314

SEQ ID NO: 1371 - DNA, 99 bp, Homo sapiens; identical to SEQ ID NO: 315

SEQ ID NO: 1372 - DNA, 246 bp, Homo sapiens; identical to SEQ ID NO: 316

SEQ ID NO: 1373 - DNA, 1058 bp, Homo sapiens; identical to SEQ ID NO: 317

SEQ ID NO: 1374 - DNA, 96 bp, Homo sapiens; identical to SEQ ID NO: 318

SEQ ID NO: 1375 - DNA, 1237 bp, Homo sapiens; identical to SEQ ID NO: 319

SEQ ID NO: 1376 - DNA, 40 bp, Homo sapiens; identical to SEQ ID NO: 320

SEQ ID NO: 1377 - DNA, 220 bp, Homo sapiens; identical to SEQ ID NO: 321

SEQ ID NO: 1378 - DNA, 44 bp, Homo sapiens; identical to SEQ ID NO: 322

SEQ ID NO: 1379 - DNA, 646 bp, Homo sapiens; identical to SEQ ID NO: 323

SEQ ID NO: 1380 - DNA, 40 bp, Homo sapiens; identical to SEQ ID NO: 324

SEQ ID NO: 1381 - DNA, 409 bp, Homo sapiens; identical to SEQ ID NO: 325

SEQ ID NO: 1382 - DNA, 900 bp, Homo sapiens; identical to SEQ ID NO: 326

SEQ ID NO: 1383 - DNA, 42 bp, Homo sapiens; identical to SEQ ID NO: 327

SEQ ID NO: 1384 - DNA, 1014 bp, Homo sapiens; identical to SEQ ID NO: 328

SEQ ID NO: 1385 - DNA, 47 bp, Homo sapiens; identical to SEQ ID NO: 329

SEQ ID NO: 1386 - DNA, 137 bp, Homo sapiens; identical to SEQ ID NO: 330

SEQ ID NO: 1387 - DNA, 361 bp, Homo sapiens; identical to SEQ ID NO: 331

SEQ ID NO: 1388 - DNA, 2472 bp, Homo sapiens; identical to SEQ ID NO: 332

SEQ ID NO: 1389 - DNA, 51 bp, Homo sapiens; identical to SEQ ID NO: 333

SEQ ID NO: 1390 - DNA, 1181 bp, Homo sapiens; identical to SEQ ID NO: 334

SEQ ID NO: 1391 - DNA, 38 bp, Homo sapiens; identical to SEQ ID NO: 335

SEQ ID NO: 1392 - DNA, 584 bp, Homo sapiens; identical to SEQ ID NO: 336

SEQ ID NO: 1393 - DNA, 647 bp, Homo sapiens; identical to SEQ ID NO: 337

SEQ ID NO: 1394 - DNA, 79 bp, Homo sapiens
caccccttgatctggcaattcgacatctaagaaatgttcatttcttccaggatttttttttttgagtcaagacttccct

SEQ ID NO: 1395 - DNA, 69 bp, Homo sapiens
cacagaccctcctgattgagtcaaatctcctgtcacttctctcacacaccacacacctccctccttttc

SEQ ID NO: 1396 - DNA, 152 bp, Homo sapiens
ctgaatctatatttcttagtatggaaagatgtttgaaatatgcaattaagagaaagagcagatcataaaacagcatgcgtgctgtagtacacactgcaaattccctcctttcttgatcatctttgggggaccacatgcgcactctcagtcaa

SEQ ID NO: 1397 - DNA, 412 bp, Homo sapiens
aagaatacggaagtgactgcttttgctggccttgtaaactcatgtagtggttggagcttcggtagccgtcttacagccataagctaaattccaatagactcacaaagatgctgggcctaacattgttgaaccagtgaaccatagccaggaaccatagatactctaactatgtaagaaaaatgaacctgtctttgtttaagtgactgaactttcagattaatgcactcccaacagatacagagcatgatcccatatatacctgtatgtgcaaatatgaatagaaaaataaagtgattatctctgcgtggtaggattctccttcattttttttattttataaagttttcccaaagggcatgtaaataataatcagacaaatatttctgtacattcagaaaataaacaatggtac

SEQ ID NO: 1398 - DNA, 717 bp, Homo sapiens
agaagatagttcactaccatatgataagttgtttagccacgaccgagatgaacacttgtgggtatcctggaggacaggttcggcagcagtgagaggtcccctccagaacagtatgtggttccaaactcctgagggagcgggggcagaccgcaaggaagtagatgagaacctgaatgaggctctgtggggagagaggatgttcctcagccctcacaaggacatgtcagtttcacttgagattaggtcctggccttggctgggcagcctgccaggcaggttctcagcagcatggggtgataacaggagtacgggaagcctggcaagctggggcagctctggggtcttcaggtggggccgtcttgggcagcaactgtgttggctgtaaacacagatttccaggaagcagagcgttgcaatctctcccaccacaaacctggaccatcttagtttccatagcagcatccatgtcagtgaggaatctggacatgatctgtgatcccctctcccacttttccttttctcttagaatgggacagagcagcctggagtagctagtgtcctgtagtgactccagtttgctgctctcttccttatcttcttcctcctgctctctgtctcctctgcatccttcacgttctacatgaggaagctcaagtcaccgggctgagcctgggcttctcatctaaatcacggagtgccagtcaatgcctcccttcc

SEQ ID NO: 1399 - DNA, 270 bp, Homo sapiens
ggagagctagaccctgttccttattccctgtgggaccatccgcagcctgtttcctcacccctgtaatgggactgcagtcctccctgcccacctggcagtgctaattccaggccgggagccctcctgggaaaatcaccagcgtgggtgatacggtgggtgtttgtgtgtgtggaagggtggggctgccacctggccacttacagaccccatccttcctctctccctgggcttgtcgcatgtcaggaatccctctcctttgtgccatgaaac

SEQ ID NO: 1400 - DNA, 176 bp, Homo sapiens
ctgtggacttatagtggagctgggattaggatgcgtgttctggattcctggcggggtcctggcccatctgcagctaaggcctgtctttctgctcccatgaggtcccttttccattcctttcctccccatgacagccactgtcaccaccacccagggtctgtgctcactgtcacacc

SEQ ID NO: 1401 - DNA, 151 bp, Homo sapiens
tttggagacctgccttatcaaatagtaacatatgttaaaaaggtaaatgatcaaaatagtacagcactacaaccagaacaatggaatataatagaaaacatggaaaagaatataaataaaaagtcaatacatccatatcacaaatcagtgg

SEQ ID NO: 1402 - DNA, 427 bp, Homo sapiens
tttaaaaaattagctctttaatataatgtgaaaagagtaaaaaagcaataggatcatgtgcacgaggtaaaaatgcaagtaagattaaatcgttaacatggaaaggaagtctttcccccaccgaagacatgcaggccctcctgcctccttccccaagggaagtatcagtatattaaacactttcacgtatttatgtctcattccagaaataaaacatttacatgtgcttgcatatattttacttcttcccccttttacaaatccaggagaattctattcatattattttatactttgggtttttgttttattgttgttttatttttacttaatatagcctggaaattgttccaactaatcaagattttttctcatccattgtcaagttaatattgttctccgttgtacaaagatatcataattattc

SEQ ID NO: 1403 - DNA, 813 bp, Homo sapiens
aatatagatttaattggggtgaggggttagagaggaggaaagcggaccaaaacatagacagtgattattagttatttttcttctttatatactttttacggtttcctaacttactagaaatacacttttaagttaggaaaaagcgataaacattataaaaggagatttttatttatcccttcaaagatagccaatatgcatacagatacaatctgttccccaggcactcctgagtgagttattatctgtgtagagcactagaaaaacactaatattactcacacattatggtgtcctactttacaagagcctactttgctgtgcaaatttatctcagaagagaaaattgcatgtgcccatatgttctggtgctgcaatctcaacaatgaattaaaggaccaaatctaggtgcttatataacccagttaaaattggagtacttgtatgaggagactcaaattatctctgctacaaggagctcttatttctctgctttgtgagaggcatctgtcaaagataaattcctgtcgttttcagattctctttatcctccctaacaaaaaacagtccagggaaatgacagttgagttgcacaaacccagtgttcagacttcctgagaaacttgtcttgaaatcagaagtcaaattcctgacctacatcaaccttaacaaacacattcctcttcaataaacagccacacactgattgctgggtacttcaggataaaataaagaccttaactctctgtattcttttcatgagagtacaactaggaggttttattttcaacttggtatttaagaaaggagaaa

SEQ ID NO: 1404 - DNA, 81 bp, Homo sapiens
taactggaagtgtctttccttccttggaactctcccacaacatcctgcatctttcctgaaggtacttttcagtcccttaag

SEQ ID NO: 1405 - DNA, 115 bp, Homo sapiens
ttcaccttgcaatatacagccaacaaacgatggtttccttccattcctccattttaaaattctgccaccttagtaattttgtggtactgttatcattcagcccacccaacacaca

SEQ ID NO: 1406 - DNA, 1583 bp, Homo sapiens
acatgcacacatgtgactgtcaatttcatgtaagcagagctgtgttttgttcacctctgcagtctcatagtacttaatgtgtaggtacaaagaatgctaaaaatatttgttgaaaaaagtaattagtatattaaacacatctaaaacatttaaaactgtaagtgttagagtcagaaaaccagatggctttttaaaataagaattaacaactaaagtatcaggtagcatttccctgagagtaacaatctaattacaaatagatacatcaaagtcccagtccctgggaacagacagcaaatgtgtacagggtgagtgtttcagtcaaatggtcagcctgttattttccccacaccctcaattctcattaccttccagcctttgaatctcctcagctgtcacttccagtgtttgatcagagagggaagcaacttggatgatctgatagaaaaaagaatgaaatgtgtggatgtttgtttgtttttaaacagacgcaattttgtcttttacaaaagacgagggaacaacaaacatcaaagatctgttgttttaagaagctgtcagtgtcctcaactgaacgctgaatctcaggcctccttccttttgtgttggtaatatactgcagatgatcatttcagaagaaaagcacacttagaacactacataaacttagaatgctaagaggaaaatttaggacaagaaacatgaataagagtttaaaaccacatctgtatatatcgtggtccaagcactacacattatttcttgaaaatgcaatactgacctagcataacatagaatggtatcagcaattatccacgcaatgaagaagtaaatgtaataacaaatacactgattacagtgttttatacttctatacagtattcatttttaaagcacttttcacaacttagctcacaagacccaagattcaacttgagttatgccagtggaactcttggaactggaaagacaccttctccataattttcaaataaaagaagaaagtgacttgcccaaaataacaaaacagctctggcaggatgatttggaaaagatcagtccaagaaaaggggaaatcacttggtttccagagaaaaacgttgaaacaatccaggatccagaattttagattctaaatattaagttaaatgtataaggaaaaaaacccctaaccacaagtttaatgaattaaaagtagggcaaacatttactttatagaattcttatcaaagaagagagaaacatttctcaccatcttcatgtgaacacacacaccacataccaattaatcttcccatagctgaacgacatacaaagaatcagaagaaactcctctgcaaactttccctagagttgaatttagaaatacataaagtggcacaaattagacagactttactccagtggaaaaatcaagaaacttaccagctgggcaaaagttgtaacttttagtctcttgaaaagctcatcttttttgtatctataatctgaaaaatatggtaagacaagtatttatctattttgcttttttagagctattctttctagttgtcaagtgacgtggtctttcaagttatttatat

SEQ ID NO: 1407 - DNA, 493 bp, Homo sapiens
attaggtgtggcaggtagtagtatcatctgttcagtttgtttccctttgctttgtcattaggaagcttaaagttgaatttataagctacctttggtctagtgactaccccttgcctttattttattagtctaccattttcctttaactaagctgtctctacttcgaccacattgtactccacgcatttttgtaagccgcctcaaatccttttcagagtaaagcagggaagaaatgtccgtgttttacaaatgaggacagagactcagagaggctgagctgccccagctcaaacagctggtgagacgttcatgccccactattctgactccagcttaaaaagaaagcaatattattcctgccattacacactatgctgaagccacaggacaacatttctaagtgtatgctgggcacacagctgtgattggttctgatcatctctcagcttctctccaacttcactccaataaaaattaacctacttagtttcgc

SEQ ID NO: 1408 - DNA, 23 bp, Homo sapiens
gttcttgtttttgttgtttacta

SEQ ID NO: 1409 - DNA, 53 bp, Homo sapiens
ccaattaataatacaactaataatacaaaatacaactaataatacaaatccca

SEQ ID NO: 1410 - DNA, 2223 bp, Homo sapiens
cttaaaacatcaatatttattcagtgctgtcttgacaattctgagctataactcacatataggtacttctgcacttgtgttcataattcttcccatcacattaaacagttattaaaaactaagccagttgcactttatctattatctgttccatagatacgtgttaaaggttagcttccttaaactgttttgaagatgacagtcaaattctgaatggttttcagtgttgaactctgcccgccctcatgctttcctcctcacctaggtttttatattggtacccatgactctttaactgctgcctcattatttcagaattattaaaggttagctggttaattgctatggccttcacagcataaatgtctcataaaccaagactcctagcaacaaaggaaaggattaaaagtatttaagattatttacctggtgtaactaatcactttcatgaattttccaaaaaccagcacagaccttaagactcagagtcgggaaatgatactactttaaaaactagccttctgtaaatatatcaaggctttttaaaaatagggaattaaacttctctgttctaaaatgtcttaaagagagcaatttggctaataacagaccattacttctaggaaatgcttagagatgctgcttctggatacaacaaggtaacaaacctatatgcagtggaacttctaaaacctgccgggatgcagacccaaataggccgagctgaggctttacaaagtacaaccaaataactacagtgttccttttgattgccaccaacttgcccaccaaaagtcgtttatgcaaatcaaaacaacaataaatcagcaaatggaaacagccaacagctttcaagtagtttgcactgtgacatttatccactgatattcttttggtatggttacaaggtttaaaatgcttctaagcataaaatgtatactttaaaatctcctttaactaaacaaagattaatttaaacaaacaaaaaaaagactgctttattctaaagattgggatttctactgtcttctgcacaagcactagcagccccctacatatttgaacctgaactccacgtacctggttctggtttagaaggacagccgtcagtaggactttttgacatgattactcagagataaaagatcaaactagatgttctacagtaagtttaaatttttataaaaaggatgacttggaaggctctgtcagtctgtcctcgcaagagcgaacagagctttaagaatggagcttctgctatgtgtcttctcccaaactctgtgttgaagacaatcctagtttcagatatgttatcaaggtgtgcttctccagtaagtctaggttctaagtctgtctctctcgagttactggaaggacagagacctgactatctaggatgtttcacactgggtccaactagtgtcatctaaccaccagaaaccaagaatgggctttgtaaattgtcaatagacatagagtgtctattttccccaggtagagttgaaagaatattcagattacaaaggatttctgcattttcagggttctgttgaaatgcattattagcaaagggaagttgggttcacagtggaagacaaatcaaaggaagtaacagaacaaggtttgtggtttcacagaaagaaatggcatctaaggtaatctgagtaaagtgatgggtctagggtatcaagaaacaagggaatattctcctccctttcaaccccaaataatacttacaacagaaaatggggaaagagaaggaaatatcttctaaaatgtagatgccaaaccagaatctaaagcaattctgtcagggaatcagcacaaagtgtgtgaaatggggtaacaggaatctcctgctctactaaaaggaagccctccactcctacagagggaaagtgaagcaagcatttttcaaggttctgttccaagggtattgttctgggagatcacctccacgtaaggtttagatattaaagaaaccacatcgtactttgaagaaatgttttaagtgaggttatggcaacctgggcagagtgggacatttttatgggacaaatttctagtgaggacatgtgaactcacactcagctgcaaatggatgagaggtgacagagacgacaaacccaaaaagaagcaggccagctggattctgcctgtcttggatgagtcaaggatggcaacaatgaagtgtaggtgagtaaatgcgatctttctccagag

SEQ ID NO: 1411 - DNA, 605 bp, Homo sapiens
gttcaggaagaaaagagaaggatactgtggcattacatatttttaagaagtttgtagcattagcccttatagctgaacatggcaaatgaaaacacagcataaagcagctcctgagtccacatctattggttggggtttcccaatattgcagcaattcaaatggaactttgatttcaaataaaaggtctgctgtgtaaaagaagaaaatgttctgatgtattctggatgtgcaattttatcttccaagaagatgtacattaccagagccaagtcctgaactatgattaatcagagtacctctttaccaccattaactaaatatcccctagcactgggttctcttattcaagatatgagcaaatccatcttagaaaatagatgtttctacttcttccttaattctggccttgaagtatacactttacatcagttttggatgcagactgaaaaattatgattttgtgcaagggcaatgcactcaatgactggtaacatatctttgcagataagttttttaaaaggatgtagatgaaatatgatttttaattaaaagaaaacagactgcaatgaattgataatgcataacactaagttctcacgtccct

SEQ ID NO: 1412 - DNA, 1591 bp, Homo sapiens
tgaatactctcatttatacacacaagaatgttctgaaggaagatattattaccccctatctcaaatagagacaaaataagacagaaaagatgaaatatcttgaagaagggcatgaagactgcagtacaatgacactagaagcttaagcagagctcattccaccagatctgactctgcaggccaacactaatgtctcctatgggatggaaatagggcagaatttaggcctacaggccacaatctgagaagcagcccagtacagcacccaggatctcccacagcccttgaggcacctgctaggcttatcggaccatccatagctctctgtgcctgtcacctgtggaacacaattgttagttaagaaccaatttatagaacaactatagacttccactctcccaaaccatcaagagtgttacttacttttcttaatctcttcgagcttctcagtatatttagtcatactgttacctaaaaagaaaataaggggttttagatatactttaaatggaagcaaatgagtaacactgtggaaacagaatggaggaaaagtatcccctaagctttcctatcctgttcttaggggattctggacagcagcaaacaggccacacacagtaaaatcttttggataatacagcgttattaaaagttgcagagccgagggaaatgttttggtagaatgtgtttaagctgggatgcatacccccaaaacattgacaagttccaggagatacagatgatcattttctatcagtttgtttttcaagtctaggctttcctcctccttttatctcccctgcccccgctgacgatctttttgtggggaagatacacagaagaggagcaaaaaggaggcagtgttctttgagtgtctaaaatgtgcctttgtggttacccaagcaactctctcctctcggctttgtcttcacagtttccttctctttcctgaacttactcttctaccgttcatgctcacgttgcagtctgaactagactacacagtctacacactagtattcaccatagatttgatgtgctgagaaataacagcagattcttgaaactgcagagaggccccagccctcatgttttatagtatgtttctataatactagtactggccaaggtggtttggaggttttcagacttaaaaaactcagccaggaaccttctggtttccaactcaattctagctgtcaagccaggggctattatattttactgggtatgcttcgatttgattcaattcaacgcaggaagctctttctgtcacctaaaaggtatggcaaaaggaaaacattcaaaataatttctcatttctaaaactgtgctcctaactttttaagcctggagaggatctagtcagatgcagccccaacatcagataaaagaaatgctttcaattaatagtagcatgaactgacattttcaaggactattctgaacttttcttcatgtttgggtcagaagcagaaaaagaaaatccttgctctgaaacccaaaatacattttcaaaaaaacaacttatttcattggctattattaaatctttaccatgaattcatcatggaataaaaatccaccattg

SEQ ID NO: 1413 - DNA, 313 bp, Homo sapiens
ttcttttcttttcttttcttttttttggtgttaagacatacactctctgtatccaggaccagaaaggaggattcagagcaggcctggacctggaagttccaagagaaatgaaggcagtcagggctgccaggaaggcctaagccttctcaagagagacactgaatacctcttagaagaggcccaaatatcaccaagattagaaccaaatacagtctttcctaggttcttcaaactgcaattgacccgagatgtgaccagatcttcagagcagaagccacaatttcttcctggacacacatctctcctgcccact

SEQ ID NO: 1414 - DNA, 100 bp, Homo sapiens
gtggagttcacttattaagtatagatttatctgagatcctatattaagtgccaggatgtgtttggtgcttggcactagtcattcagtggagaaaaaaaaa

SEQ ID NO: 1415 - DNA, 373 bp, Homo sapiens
atacccttagatgcattcaaaataacccttctcttctaacttccaatgggtgatcaagcttgtaaacttgactctaccttgggatatgttttctcaccattttatacactgcttaagaggtgaaagggtggttgatgctcctcaaatagtagttagggggtaggagcttgttcagctaaagcctcttcccacgaggcttattgagcctcactcaaatgaaattggagctgattgaccctgtggagcactcataatgaccagaacatgagaagttaacagtgggactgcatttcagctctggtgctgagaccctggccacttatcttctccattaggccatttatagcacatatttaaatcataactttgtatc

SEQ ID NO: 1416 - DNA, 217 bp, Homo sapiens
agagctgaagatttttgttctcttctagcaactggcacaacttagactaggcttctattgttttcaaagcacaagacgaacactcattgagtgatttcaaggtcccctttttgccatttctacctactgacattctagacactggaactgtttttcacagtagtatgtttagtcactctttcttccccaccgtaggcatcatggtgaaggaaaaaaa

SEQ ID NO: 1417 - DNA, 70 bp, Homo sapiens
tgctatcccttgctgccacatctaaatgctcttatttgaaatcaaagctaatattgctccctttttctgt

SEQ ID NO: 1418 - DNA, 83 bp, Homo sapiens
gttgtttgtttgtttctccaggacttgtggctactgagaagactagggccaaaacttgtatttaccaagtacagtgtagagtt

SEQ ID NO: 1419 - DNA, 1873 bp, Homo sapiens
gagtgatttcctggctgtgacttcagtttgtgcatatattagtttctatttgctatatgtgaaagttctgatgttatatttgcagagctgttatacctgtaggctaagttctaagacttatcaatgccctcaggcaggaggaacaattaatgtactcataaatggtacttatttatacttctaatctcaaaactaattgcgaattattaagtaaggcctttatctttattgaaaattttaaaataagaaaatgctggctaaatctaattttctaatatcaaaatgcaagacaatattcaaacatctgtgaaatataattatacttttattattacttccctattaattattagttgtaaggcaaaacattaaatcaaatgcaatatgaatttggcatctaatctttgccagtgtaagtgttttttcagtgtttaatatttgactgtggtgtatatactcatatgtcacatagaagggaaagaagtaatcgaataaaatgtttttaattcattggaatatgattttgttctctaaccatagattggcttaaacctccaaaacaagttcattgttagaacaaatatttcaaatatttcctgagcacttatttgagtgcttattttagtcagtatagtgttcagtgatatgggaagttcagaagattcatgggatttacattctggattttagaaggcttcctaacaatgtcacaagcctattaattgttggtagacaagaaccaaaacgaaagcccaggtctcctgtttctggtttaatcatcattttcataatgctttttccccataagcaggcgctcagtatctagccaaccagatattaaaagatattgaaaagcaggcttcatgcatccctaacaaattgttcacttttattctgggtaaactttactgatcataaagttacaggcttcagggctctctaaaataagctaagagtagccaataaataaaagtacagcactatccaccatatggtatttcacattttaatctattttccattcagtttgcatattatgcgggcaggaaagccctaaagagtcatgcctaggtattccatattaagttactttaacatttttaacaagtatatgttaatgaactaggctatttggaagactgtgtcatacagcctcatcacccaaatcccttccaaaaacagaaggtcgtttgagcattgtttgtaggagatttctaggctctttgagtgtgttggttgggctatggagaagggggatggattaataaatggattagactggactgttgagagagcccttgaaggctatgccaacagatacaagaaatagtgctccagacatacctttatctgttaaatgatagcctaggacactgaaatgtttacacgattatttataaaattccataaaatgcatttgcagcttttaaagatataaatgaagcttatatctaagttgtggctataatcaagttaaatgagaataattttagaggggacagctaattacagaggtttttttttttcttttagaataataaaaagtaacatccaagcctggaataatataattggaagcctagaatttattgatatatgtatacatataaaaataaaggtaacattattttgctcagtattcatttccattatccgatcacagtttcagagattcatgtggaaatctgacatagtcttggcaattcctgtattggaccccttcagtttcatgtatagctccacttgagctaaaccagaaaaaagtgacataaaattgtttattcttttgacatgttttttgacaacttcctcaaaaccattgagatactatcttggcacaaaacttaatatgtctagcttctttaatgtcaag

SEQ ID NO: 1420 - DNA, 410 bp, Homo sapiens
acataactctatttagtaaaattttaattaagaacacgtattttattactgcaaattgaaaggcttacataaacatttcaactttttaaaagttgtgattcccaagaaaagaaaattaacttaatggctgttcattcatcacctccaaaaccaaagccatttgaatatttcctttattatgatgtattagaacttcattaaaagggaaaacttacaagtaagttatcatttttggaggaagatcacactgtgctaaataatgagatacgggaatacattgaacagcttgacttctgctgacttttacttaagagtgtgaagtgttttaaattagactatgttagtattgatgaaatgtgcacaaaggggaaaaataatttaaaggctttgttctattttgagagctagat

SEQ ID NO: 1421 - DNA, 24 bp, Homo sapiens
actgtgacctgggattaagaaaac

SEQ ID NO: 1422 - DNA, 369 bp, Homo sapiens
acatatattattatgacacctctttgggataattaaaaaaacaaacagaaatacctacatatataggttcatgtagatacattgatatttatattaattacatcaacttttatattgaagaaatatatgcatctgacccaatgtgcttattcagatcttacaagttaatacgtaagcattggtttttggtgggaagaggttctagatagaagtgaattggaggatgctttttctgctcatttgattgctttctgtaatatttgatttttgtaatcatgtatatgcaataactttatttttaagcatgtccatatgagtgttcttaagtaaaccattattattgttctttatttttatataccttaaaat

SEQ ID NO: 1423 - DNA, 1231 bp, Homo sapiens
gacaataaagccctgttgttgagattcccaaggtcaggaagcataacaaagtttagtatatcagcattgtattgtcaggaaatcagctcaagttttctatgtaatattctcatgacaaacaaaagtctgctcttgcagccaccaccccctcattgagaatgcatcccttagctttgtaggatagatcagcttgatgttggacagttagagacattgtatctacctccccttctgagcaagaaaatgaaatcaattattacagttgttttcctcctctgtagtaagagaacatatggcaaacaaaggcctctctaaatatgcattcatacttagtggatccatttttgattcagaatggggagaaaaatggttgcatatttctcatgtaccctgcagtttaatacagcatactctattttcaaagcagttccagaaagaaacaataaaatgactgtcttctgctctcttgaatcttttcagaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgtaagctaatcattttgaattgttataaccagcatgcattgtaggagacagctaacaagagaaaagcacagaacagatatggggggttcacatgtgtgaattattagtttctcttacataaattttcagctatcctttttaaataaagaatgccatcattgactttctcctagattaattcaaacctgtcctgccagaaaataaacatttgggtaaattggactcttatctaataagttacattaaaggaaattgaatttaaaaccttgacaatgcaaaactataaaattttaacttccattttatactcaaatgactttgccttagactatgaatatggctggatgcattttttttctgctattttttttatggctcttagcatctaagaaagcatctgctgtgtatcaagttatccaagttttctccagggaaaggattttataatgtagataaattatagttaaaaattaagaggttttaattatcttacccaagacacaaataagtttgcctcatctaattttataattattaagtagtatttaaacagttaatagtatttattgaagaatcatatgcatcttgtgccaacctagaattttaaagtttaaagta

SEQ ID NO: 1424 - DNA, 162 bp, Homo sapiens
aaagcacagtcctttcattgatcaaacttagatatttaacatttagaaatatgatgtagaaaagcaaataattatacattttggtatcatttatgatgaaagcatatttgtttcattacaaaatattaaactggtgttacttttccttagtagcctgaggtg

SEQ ID NO: 1425 - DNA, 250 bp, Homo sapiens
catcccttaagttaactcttcattatctgggagtagggacattaggtaagattgaactagtggggaaagtattttcgcatattcttggtgacctgtccactatttaaaaacttaacatttttttctagagaagaaaaaatagagcaaaggtaggcagaggtagaagcttttagaaagtttcacccaaactgtaatttatatcacttttgttgcaatggtatcatgcatctgaggtcacgggtactgtaac

SEQ ID NO: 1426 - DNA, 54 bp, Homo sapiens
caactttattctacatactacctttccacctttttatttaattaaattaattaa

SEQ ID NO: 1427 - DNA, 1910 bp, Homo sapiens
accttttttactttttaaaaatactttgattaaatctgccagagtggggaactattaccaatttgactccttctcgctgtacctctccaccacctggtggtgatgctaataagcaactgaaattgttcaaggaaacccacacactgagggctggcgtcctacaaaggatagaagcagtttacaaagcttgtaggtaatttacaaattatgtactcaaccctacattatggagcgctaactatgtttttttttttttttaggaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaaggtaagctctcggttgaagctattatttcacgtaagtacactgaagtaaagtaaagtgagttgggctgccattttcccacctttatggttatcaaatcccattgaacaaggatcacatcttttttattgccgcaagaaaagattttcacttaataggtgcaggtttaaaaatgaactggaagcagcttaattcactagggatcacaaaggctacattcttttttctcaattcatcatgatagttcaattctttgatctacttattacagagctagttcacagctatactctgtttttcttaatttttcacttattcaagaaaaatatagtcaaggcaacaaatgaaaatacaattttgcctttgtgctttttgcttcacccttaggaagcataatgctagttcatcacaccagtcaatatggaatatttgctgagtgaaaaataaagctctcaagtgtgcctaatatagcaagctatgacataaaggataatagggaagatttcagggaagaactcaataataatcccaaaaagtttaataagttataaaaggtagctcaggtcaacttggctgaaaatgagatctagtgacaatatgtttgataaatttgaaagaaattttgattttacagtattttattgttctgcataccaaaaagaggaaatagaaatggaaagaatgcatagggtccctcatagtttgaacagattagaaaatgactgaacttgatttttttcagaatttaccttcataaactgaattttgaattttggaaaatcttccacctcaagaagaaggcatgagcaaattttagaatttatttctgccatcttatttttttatttagtatgctttctttttctcctcttaaactttgctttttcactgaaaagcttacatattcttctgtaagtttaaaagttgtacattctttacctatataacatacagtggtcactgttaatttaaaacatgcactcattgtttatgttttcctatgatttcttagacttttcaatatctctatctgcttcccaaccttgccttctcaagactcttttggtctctgtaccatgtccccaaatcccattatcacaatgtagatttttagttttagttgaaataatcacttgttcccttttttggttttttttttcctcaaaaacaaaacaaaactttatcaagacacttaccatccttacttccccacattgtttacaatgccctcctggatttatttcttttattatttgagtgttttcaatttgagtctgatgtccttaatctttaattctaaaaatttgttttcatgatttcttgaaatatttttgctcactgtttttattcttccttctcctgttgaccagatttgatccttccatttctatttatattatttggcttttcttatctgctttctggaagcatttctgttttctgagacagttcttcaatcttatcttttgaatcgtacaatctgt

SEQ ID NO: 1428 - DNA, 1703 bp, Homo sapiens
aaatccttcttacgctatagctttgttgctgtctcatccgttgtttcttgtatttcagttatttatttaatgctgcatgtataacttaaatgctcatgccccttcacttaaaaactatgtatatttttatttacttctgatattttttaccatatttcctctttgttctttttaatgacttctttttcacattttattttgctactatcttccattatttccttgagtatattgctggcatgcttattttaaattcctcatctatcagttttggtagcatgatatatattgttcagtttgttgcctttcttttgaagtagctgtattttttgtgcattctctattttgtcctttgagcttaagtcctcctgcagacattatttattccagctagtatgatgtttggggaaggtcagtcctttcaggtgaatccaaggagaagggacagaatgtgctccaaacatgaagaaaccacttttggtcacttccctttgtagccaggtaacttccctggtcagaatttcaccccctaaactctcttaggcataaaagcacagggaggaagcacatcttcctccgttatatgtcatcaaggctgaaggttgacagacagtagggtggaggagtgaatgccacatgtgaccagtaactccatacagtttttcctcctttctcccaagaaatttagcaatctgaatcctgggcctgggcttagcatccttaacaaggaaggaacaaccaataattgccctagaggaagacaggggagagttaggaggaaaacgaaaatattttccttcagcctgtcctctcaaatagcctccaacaactcccctcccccaactccacttatccctgaccgtggctaccactggtcagaccagttcacaatagctctagactccctttcaaagaggtgtttgttatttttctttgttatcaaattcttgcttcattctcatttcacctgggctagtgaatcatcttaacaggaaactgaagctcttaggtattttaaataatttttaaagtatttttcctctttgtatgtaagtgccgctccccctaccctgatacaaataacaggctaatttttatgatagtttttatttatgtatttcctgaaaataaatgaaaaaagaaatctccttgtgatctggttttctttagattttcatgcttcattcactatctcctttcttattcatatttttgtcttttctgtgagacagatgcaagctgcggttgtagcataggaaagcatgcagttcttgtcattttcatcctctccttgggatttatcttttcaagatcttgcctgattattctggacaatactgttatctcctcagagggaggtagtgcagcttcctgggtcaatgtggagaaagtgattgtttccttactagttcaaagttacgcttgatgatacagataagtttcagaaaacaagaggatatttatttacccttcaactgatgtacttgttatttcagttaaaacaaatagattataactcatctgttaaattacttaaccatcctcagaaatactgctttctactggtatttttagatgtgaaaaaatacacagaaacttctcactgctaatgtggaggacaaaaccaaacccactttaaaaactacccacgctataccagcatgttattaaacactgtccttaaattccacaaaacataattt

SEQ ID NO: 1429 - DNA, 480 bp, Homo sapiens
actgagtactgaattcaaagcccaaatgacttagttaaatcagtagtgatttatgtactgtgtgatgaggcaagcccactaaactagttatcagtgaacatttatagaacattctggcagctaaagaaggtatgaaggcaataacagatataactatgagctcatttatttccaattaggtcttctgctgagatactttatctgttaaagctttggagagagtaaaaaaaatcaagaaatgcaaatttgaggaataatggaaaatagaagctttgtaaactatttttaatgcccttctacataataaaatatttaaaaattttagtgttagatgtttcccaaggatgttcaaacctaaaatcagaggaagttttgaaagggaaaaattcgcaaatgtaatatttgcttactataccatttgatctgattttaaatcaactctatttgttgctgttaagacaatatcatttacttgatgag

SEQ ID NO: 1430 - DNA, 1408 bp, Homo sapiens
gtcttcccttaaaaagctcttaattataaaacttcagtttgtatctataaattcacgagtaaaattctttcacaaatattctaactataacttttggttaaatgcatctatgtctgtcttaaaacacaggtcataaagattaactgcaagaaatgtcataaatttaaattcggttcttagagcaaaaagtcacaagtcatcccttcatccgttgtaaatcacaaaataagttacccaacagagaggcaactgtaatatctgtaactttttatgatgtctgaagattctttgtacttctgaccatatttgactatttttatgaaaatgtatcgctgaagagatttgtgacttctggcagaaaagcttgtccaaagccttattttgtccagtcaagacataaattaattcattgtttgatcagccatcccatatttgaagatgttagatttgttgctattccatatttgacatcagatataaagttatatgaagatgattccttgcatataatcagctccctataaatgtctcttcgattgaattgaatcaaaggtcattaaaaaaattttaactgcatgaagaaattgcctgagtctactttatccctaactgctataagccagccactctactttgcaatgatatatacatgatataggtaaatattatacaaatgatcatttgttttccagtaaatgcaatagacagatgtcataatctgaatttctggataagggccactttgatagagatagggaaatctgggataccgtagccttttttcaagtcagatttgtaagttctaaatcaccagctctctaccaccgctgcactggccttcaggggaccattcttccatctccagtgcttgcagttccctctcacatcaatacaatcagcaaatgtgcacagagggcagaggagaactgtggcaaagagaggaatggtgttatgtacaagattccttttaaaaagatgcatatatcccttattcattttggaaatatgacacagttgtagggatgaagttagcctcatttgtcgtcaatatttatgcactgcctttgataatgttgggtgagattgcttatatattcccaaggtaaaaatgagtaatgtctttggaagaaagtataaagtgacagtatggtttttcaaccttaggaagtgttcttcccctgatcttcattttatgtccaaaactgcaggctacgaagcagaccttgtaaaaggcttttgactgagcatctggcccttcgctaggcccgggagatttatgtcagctgtagaaagaatgtgaataaaagtcttctcctgagagtttgtaaaaagagttgacgtattacttaacctacttttgcttgaattaaattttaaaattgcatcagggtgttcattttaaagtatg

SEQ ID NO: 1431 - DNA, 140 bp, Homo sapiens
ccagcatgtaattgaataaacttgtgaccaaagctgacttactttaaaaacttttataataactgcaaagtaatcagcccacattgatgttagattgcactaatactctttatagcaactttgtgtctttttaaaaagca

SEQ ID NO: 1432 - DNA, 149 bp, Homo sapiens
ccaacttggttctattaaaagatttgtcaagtcattttgtacattcgttaattctgaaggctgaacttggatgattatcctaaatgtaaagaaaactattcattaatgatgatcatctttatctggccaaaatgataacttaagcagat

SEQ ID NO: 1433 - DNA, 248 bp, Homo sapiens
cgttgtctatcatccttattttaattaaaggtacctcattaataataacttattaaaaactgccatttggggaaaatatgatttaagagcaggttctacaacagaagatagtattatggatttacatattccatcattgttaattcaggcatattttcccttctgaactagggtaatgaacgcatagacatatgcaaatataattaactaacataatgctttatataggtagatgctatataatgctt

SEQ ID NO: 1434 - DNA, 2461 bp, Homo sapiens
atgtattatgacagtgtaaaggtaaaacctaacactaatgaataaatttgctaattattattgcctttaatactagaaaatcagtaggcaagtgttaattatatatccagaaaaatggaggtaagctaatactcagggatttcagtgtgaaatcaggtgaggtaagttcattccttcttccctccttctggatgcttgaaagatggaaaagttcctcaatagtactttggaggatagaatgtatgtttcccttctcagctcctccccttcacctgtcctgttcacagcctgcttctccctggagccatcaagggaaggtatatgctgggatgaggatgggacccagttatggacttgaaaagagcaagtgttgtttctctgaactggatcctggaagtgtattgcccgtgaacttcacagaagctcttaaaaattaatctctgcgggctcttcctctttctgccgttgcccagcacagtaatgtcactctgatttctgttacaccttgccgataacaagtttataaaataaacaagtgtttagagtaaaaaccaagcctgggaaaagaggtctagtgtaagcaatctttcaaagcactttaagcgtccatagagagcagcaccatcttaattttttagtttcttattatttctttaatagatgagccagctaagccgtagagatgttcgaagacagaacagctgtattccctttcttcactaccctcatgcaagaaaggattgttaagatggatctttgggaaatggaccatgaattaaggcaaaactccctgcaatcttcctaaatgttttcatttctgtacagacacctagagagttattgaatttaattttataaatctttatccctaagactttaacaacaaggcttaactttttcatcactgtggtaatgttaaatatcttctgatgacaggaaaatatattggaaggaaaaaatcacatgaagtcagcaaacaggagaacaaaaaccaagaggaaaaatctacttgcctaaatctttttgaaatccttaaaagaagagagtttgcttattctttatttatgtaggaaacaaatcttcagtgcctggcatagtagctaatattcagccgattcagggagagagaaatgaattagaatagagactccactcatcaaattgctgaaaagaataattagtaataaaaataactcctttacaaagtggtatgtgggtgcaaagtaataacagtgaaaataatggcagtaattgtctccaaaaattaatcgctttaatgcttaagtttattacagaatatttactcagtggggaagttaaatgatttttacacttttactttgggtatagaaaaaaagtaagtttttaccagtacgttttgaaacttattaaatgtatatcatttttgagatttttattaacaatatcctttattccttgagatctgtctcaaaggctgacaaattctaaatataaaatatcctcaaatgtgccaactaggtaaaactgatttgtctgctgaaggaagacaggcttttgctcccttcaggagaaaatctgacttgcatttgtcttatgtgatttattcattgtaagtttaaaatgaaatacagcctttttccttccatatattaaaatgtggtttcaaatttagaagaaacagcaatcttttttcactaaggaagcctacatagcagtgagatggagcaaaacaattactgtattgccccctagtggtcttttttgctattgtacaaatagtctgagctgtccaatggcaagaggaaaaaaggcaaaaatgcttagcaaagcatggagcatttttcccccattggattaaacatatttattttaaaaaagttattttataacccatacttacagtaagaaagctgtgcttttaagtagattgcgaatgatgataattcctcactacaatttaaattacctaggccacacaattatttggaatgatttcagcatttgccagccactggacattgttttttcacttaagaacactttgtaaaatttaatatgcagtgctattaaagaatgatatccctcagatgactatatgttaagaaaattcattcttccagctcaaattcatatcataaaatataataatcttaatttttttctatggaaaagttaagcctattagtcataaacttgtgagtatacatttaagtgaagaaatgtacattttgtaatgtttttttcatataaggaaattcaatgatattttctagagctctttctcctcaaggaatttacttgagagtggtataaatatgcaaagtacacaaatataggatatttttatggaatatggaatactgacttagaagaaatgacttataaacatgctatactgtcttatgtgtagatcatacaaaatatgtcagggatgttggactgatttccataaaactctagtctaagccagtcaccacaa

SEQ ID NO: 1435 - DNA, 164 bp, Homo sapiens
ttttgtgactcctgcctgtcactgtgccccctcagattctgaagctaagtaacctccaaaccttcctggtaagagcgttcataactttcactgtcaaaaacaccatgcctagtcacctttggcgtgcattgattggcctaaagaattttactttttccccttgc

SEQ ID NO: 1436 - DNA, 854 bp, Homo sapiens
acattcttacagagaaagtatcttcaagagaaataatgtttcttacaaaccttaacgagtcaaagatcatcgtgtgtcaatcagcaattagaaagtaataaatgtcagctctaagagtctgaaatatggcccccaaagcaggaggttcttactaaaggtcaaggcagcactgactggctgtcagaggcagggacagctacttacaatttaagattagcaagcccctaaaaataaggaaagtattttctcttccttcccatcctcctgttccttatttgtttaggagagtgtgggtagggaaaagataatgttgtctgatatttgtagcaatgattggtatgtgcaatttcaaagagaggccagatgctaatgtttgtaataaccaaatagcaggcatgtcacctgtttgatttgccaattttaataagtcctgtgctttaatttgtaagggtaatttgagtaattataaatatgtaaaaatagactcattaaacattctggggaatcaaagggctgaatctctgcccctacttatttatgatatattcatattttttcaatgggtcagtagtttactatgatatatgggagcctaaagcttggggggtagacactcccgttttccaactggtagacactagtctaccccccaagctttaaaagtaaacaactacttcaggatggcacatgccactgaaaggtcagtagggtgctatggcagattctctcaattttctaccaaaaatatatatcctccctttattctctgcaaagcaaacctcagttttctacagggaggcatcaggatatggaccacaatgagattaagttcattacaacaatcctttaagcat

SEQ ID NO: 1437 - DNA, 86 bp, Homo sapiens
actcatcacttggaatgggtaggaacaattctggaaagcttttgctttctgagtaaaatggagagatgccagtggttccagcttac

SEQ ID NO: 1438 - DNA, 153 bp, Homo sapiens
tgtggctcaaattataccttacctttcttcctgctttaaacatgagtaagatgcctagagctggccctattgttctgtggccacgatatggcagaataagagatgctgaacctgccagtatagagtgaactgaacaaatcacagcagcacttt

SEQ ID NO: 1439 - DNA, 285 bp, Homo sapiens
ggtgctttagcagaattaaaggatttcaacatatgtatctttctcactagggagacagaagcttctaacgtcttctccccctaggatccagatcctacgttggctctgtgagatggccaaggatactctaaatactaataggacctagacaggggactacattctctcttttatgaaggtcaaacagttttaagtataaaatgctagcatacaatagtaatcacactccagtttccaactgggagataaaaagactggcctctatccttagaacccaatttattt

SEQ ID NO: 1440 - DNA, 685 bp, Homo sapiens
cttagtacccaatttaaatttgcctggagttccaagttgaggaccatggaaaatctgtatgggactaaggatgctggattctcccttcccctacagcaaccattcctagtaaaatttgatctgtgatctgtgctaagagtgccctggggacaggtgcattagggtggtgcctctcagagaggcagttagtacagcagcatagtctgggcacatactcaatagcttggtggtccagaaagaagagaacaacttttgccctaggtgaccacagtaactgcaacctcatcctgcagttatttgtttaacaaaactaaggaaggtagagaaagtcttcaataaggttttctgggcttcttggagccaaactgcccaaccaatggtactaaatggaactaaggcatgattttccttcactctcatatagtatattttcctaagtatactcaagggattaaagggacctgcataaaattaagatgtgagatggaaatctgaatgactgaggactgtgagtccagtattctgggcaatatcaggagagttgacgtactgctcccaagtcagtaagtgtcttgtaccttgtgtctccggcaaagtataaagaggagatgctgaggccctttaatcttacacatctgcacaacccactgtgaggggctaaggaggtatctcataaatatccctt

SEQ ID NO: 1441 - DNA, 13 bp, Homo sapiens
atatatatttttt

SEQ ID NO: 1442 - DNA, 1166 bp, Homo sapiens
gagatatctgaatagatatatatgccttgagattatcactatgcccttgtgtcaatgatctaaaacccattaagctaactataatctgtgaaaagtgttttgctttatctatacaaatacctgggaagatgggagggtagattttctgggactttagagcaaaaatcatctttgtaccacaggaactacatcaggataggccatgctgagagcacaaccacagtgggcctgtgaccagggttgaatacacgtcctgggcatcctgagcaacgagtcaaggtcacctgtggcaggacactaatgtcactgcaatggagtaaaagagccagcctgtctcagtcactccagttataaaggagatcaaaatgctccaatcacacttgaaaatggtgccgggaaaagagatcatgagatattagcattctaaagagaatggtgtatatgatctggaaatcagaacttaacacctcagaactcttggtagatgttttctttctactgtccaacctggaaatttctcaggaaagatgaatggcccatcaagggtttgagactagaaattgagtgacttaggggccactgtaacacacagcaggcctttatggagaagaaatctgaatctccctcaagtaaacagaggcataaataaatcattggagcaaatggaatgtttgttgtgttgggggcagccaatttattgctcaaagaaatagtacaatgttacttttttgttttggcacaattcttgtgttctgtattacctgacatgactttttaccaataaatataatatgtggttgcaattataggaataacacatgtaatgtatgaattaattgtgtgttagtggaagaaaaaacaaaactgaaaagaagcagtatcattaaggtgaagaatgtgtctctttttgacattgctggcataaagcagtaaccccactctcaggagtatacctggtaggaagaaacccttgagaaatggatagggatccctaggaaaatccctctttgttgtgcttcttaccctttaggcaactattaccttgtaataatattttgttttgttacagtgtaatagttaaacaactgaggtagaaattgtatgtttcgattgtaagattcaattagtgatttactttaagactatcagtgggtcattccaccata

SEQ ID NO: 1443 - DNA, 165 bp, Homo sapiens
atcctatactcaaaatacatacaatatttatttacaaaaattacatcaggtaatacagagggcaaatatgtgccaaagacaaaaagaacatttttagagccataaaaagaacattttaagccatttcctgaagcaataaactggcttccataaaaaacacacaca

SEQ ID NO: 1444 - DNA, 426 bp, Homo sapiens
ctgtattttttagcccataaaagcctggtgctttttgttgtttttgttttgtttcattaaagataaaagccatgactacacatgaccccagaaggaaagcctctagctagcaccgcctctggatgcacttcagtccagtccattgctgacccctgctggaactcagcgaccaagttgctgtctgtcccttgactggatgagtggacctggaactccttggggaccggcagggtgacaagaggctgctgatatcctctttgccacctacttgttccataccctgtttgtaagagccgtatctgtagtcctacctctccctggggattttcctaattctaggggtctgcagaagacagattaaagctttcttttgttttatttatacttggtaactgtcttctcttataaagacccagtaagaggggg

SEQ ID NO: 1445 - DNA, 78 bp, Homo sapiens
cctgctctgggttccactttcagaattaagaacttaatctttaaccagactaaaacttgacatgaagtagagaatctg

SEQ ID NO: 1446 - DNA, 560 bp, Homo sapiens
ctttcaagttgaatcgtaaatgtttgtatgttttgaccattttgcttttcttgccctttactaaactagaatattttgacaggtgaactaggattctgggtcaagctctggattatcaagagctattgcggaaaaataagagacaaagagtattccggagtggagtgtgtgagattttcctttgagaattcagattgggctcatttcctgtgtggtttgtgttgacactcccctaactctatccctccaatgagcttaagaaaatgggagtgagtctctgaattcctagtgagggatgaggggcaaaagaaactccctgtccaggtcctagaataggcatgagagggcctgagctgacactcctatacacgggcacaaaggttcttatcgatttggattcttggtgtactatgatttttctcaatataaaattatctacctttgctgcactcaagttttgggcttggaattgtattttgactctgatattaattttgtcacaccttcttgcttttattaacacttaacatttgtttggtatatcatttccaaacctagga

SEQ ID NO: 1447 - DNA, 124 bp, Homo sapiens
tgcttttgcttttttaaccaacattattttgtttctggcctttaaaatactttaaaaggtcaatcttgttaacttatacaagcaatacatgaaggtattctgctttttaaaaaaagtcaaagta

SEQ ID NO: 1448 - DNA, 82 bp, Homo sapiens
gtaataaaagaaagaataaaagcattatatataaggctagagagcccctaaccaacactttcaatccttgtcttctctttaa

SEQ ID NO: 1449 - DNA, 27 bp, Homo sapiens
cttttctttttttctttctttctcttt

SEQ ID NO: 1450 - DNA, 148 bp, Homo sapiens
agtcctattttcttttatgtcattcagtaaaagttttatagtcttcttcatagatgttctttatattatttgttgctaccaaatatggaatcacttagtctattacattttctgattgatgattactggcacataaaaaagtaattga

SEQ ID NO: 1451 - DNA, 59 bp, Homo sapiens
tgtgattacctgcctgaagtttgtctagactttctttgtatcttaccatgtggccgata

SEQ ID NO: 1452 - DNA, 1494 bp, Homo sapiens
agacggttatgcctttttgcttcctaatttctattaatttgatcaataactttgatatatttcatgtgtctcatcttcccacactttctaaagacttacttctttctgtacgttctccaagcaaccatctatattcccactgacaatggtaatatcactgaaactaagctaaaaatacttggaagtattgtttacattttctgtaatcatctactatacctatctcagtgatagggatgatttcccagtgctttctctgcaaatttaaacaggtatctctcaatattttcttgggcctgagatcctgagtgaagacagacattcatgtaaagcttgcgtccattcttttgttagatctcttagggttctaatcacctcctctaacctactaataattaaaatgccactctcctttataattccatgtttaagattgttggctactggtctttcttatttttcttttcacatcatcaatactgtcctctgaaaacacaacctttcttctaaataaatccttctcttctttcagcttaatcaaaccatcatcctttcttcagttttcacccttgtactgcttctattttgatttcaagatttaaatatatatatttgaaacaaatatggctcccattttatttcctgaatagaccctgattcctagggagagaaggattcaggcaaaagcctttttaatacttttcctgcctttgggattatggtatacaatgcttttctcttcctcaaacccctatataacaaaaacttccattcctctttatgtatttgtgataaaatccaccatttctctgtggttgaacacacaagaaattcagctgaggccttgaaattccactgtcagggcttatatagtaaacacatctggcaccaacttggaatataaatagaaggtgattctggatatcccatatgaattaaaggatttggagcctcccattggcctctccttagccctattaaagggtgcatttcaaatccagataatggggaaactgatctgataccacctgatacttcccagaataatttaagagctagaatgtccctaacctgtgctcttacatatacatggaacttatgccactgaccttagaatcctcaactgcaattctggctgagcataaaggcagcacaaattgatctattgaatagcgccttccctttctgcagtgatcctgtctcagttacatctatgtgaatcaaaatcagccacagtgttctgtacagctcacttttgccaaagtctatgctcagtgactctaataaattagtggcttgtgtgaggacacttgcgatcataggctgctaagatttgaaatgactaaagaactgaaaggctgaagatcattaaagcattaaagccctgtactctggcattacagacatccaatctccacacatcttattttgattccctaattccaggtgaagtgcctatttctcaagatttaacaggcaaggcacatctcaatg

SEQ ID NO: 1453 - DNA, 540 bp, Homo sapiens
ttactttgctgattaagctgtatcatggtcaaaactgagctttctaatacactgtctcccctactcctcctaattcctggtcttggatctggactacccaaagaaaaacatacagtggaaatacttacctggatagcagcaaggaacagagctgccccaaaagtagaaagagagagaggtgttcttcaaacctgcctctagaaggcaggtctggggctcagcaggtgtgtttaccctatggaagcaggatctgagtgaagtgcatgcacactgcaggcagggaggtgcaaaagagagaacttaagagtgtgcgtgtacaatgacccccccccccccatgtctccatcagagaatacaatcatttctcctttggggagaagtgtgtagaggtagagatgggggtcaaaaatgatattccagaatggttccctgcttggagaagaacagggaaatagggacaaatgacatattcttgcctccatgggtggggacaaagcctgtattcttcacatcctcccagcagaagcaggggattcaact

SEQ ID NO: 1454 - DNA, 143 bp, Homo sapiens
ttttgtcttaacaaagatttgtctgtatatttagacaaacttacagaggtttgtctgtagtctttacaaataggcagcttttgttgatcatatatctgtttcttttaaaatgtatatatttgtttaatttctatatttatttt

SEQ ID NO: 1455 - DNA, 513 bp, Homo sapiens
aaatatgaaatttttggaagggtgctgtccccggatttccctggcattgtatcacttgaactattctataaccagtgctccttgtgtaacctctcaggaactgggtctggaagtataattggggattatttgaaaaggaaactagaataagggtaattttttaatgcagcgtatactgtggccttgaagtaaatgttaccaaaatgttatctctcccaagcccattcagaagcttgcaggaacaacatcaaagagatgttcctgaaggccttgaacagctgactggtccattcttttggtcacaagtagttcagggcatgtacatagtaggtgttacataaatatggtagaataaatgaataggaatatacaagctgacagattagtattactattcatttatgattattaatcccaaacagacattaaacattcctagaaatactgcacaccagtttgcatctgttgccagtctccttcctgccttttggcaaaagctagtctgttctagtt

SEQ ID NO: 1456 - DNA, 100 bp, Homo sapiens
agtgggaggcaggtcatgtagggccttgtaaacaatgtggacagggagatgggaagtcttaaggaggattgattcaccttggttgctgtgtggctagtag

SEQ ID NO: 1457 - DNA, 47 bp, Homo sapiens
cttggagatagggaagctgagttggctcttggatctgagtcagatgc

SEQ ID NO: 1458 - DNA, 784 bp, Homo sapiens
tagtctgatgtttttatagttcaatgaagtccagctacatccctgactgggcaacaggataaaagggattttttaaagctatgtgtttttatacgtatgtttctggagaacaggaattctaactcttagtagagtttttcaaaatgccatgtataattatttgtttaatagttttttattataatgatcacaagatgttatctaaatatacttaaaaccgattgttttgtgtcaaactataaaaacaaagatttatattttaggaaatctaatcatttaatatctaatttttttaagttcaatttccattcttgataaaacctctatgttcttagctgtcaggcttctgttagatccgctgaacttctttcctgtgacattcacgctcatgttaatttacaagtctaaatgaactatatgtgaccttatgaaaaacagatgagcttttctttggtgaatttcaaacactttttcagtgcctgtagtgttgtgggcacatagaaggtaaaggcacatagcaaataattggaaaatatttttatataatgagactgagagcaaaggtccaactgagatgtttatatgagacagaaaaaaaagtgggtggtgttaagattctgcagtatgatagctcaatagttcagcagtatgtgtggtgactttggagtctaacaagccagattcaaatctcagcatgagacataggaccctctcctttcccatgaagggaatagaaattggcgcaacagtttcatgataacctgtcaagatgatggtgttcata

SEQ ID NO: 1459 - DNA, 74 bp, Homo sapiens
tgctgcaaatttttgaagtaacttattcattaaaatgtaaggcaatactacacagtagtaaaaataagcagtga

SEQ ID NO: 1460 - DNA, 140 bp, Homo sapiens
ccaaaactagttagatcatggataatgctttctgcttagtaaatagaatgaaaaaaatctaagattttagaagactgtgtcaaatatgatatcttttacacaacgtaaatacatgatcataattactatatcaacacgtt

SEQ ID NO: 1461 - DNA, 481 bp, Homo sapiens
ctgtattcattattatgtattgttatccacatattattcatatatgtccataatacacccatacattaaaagtagaatacattagcaggtgtgataaataccaaatttagagcagtaagtgtctctggtacgggaggaaagggaatggagtttcaacagattcttttgttatttgtttattttttaaaaaatctgaagcaaattaggtaaatgagatttgtcaatatgagcctaggtacagtgctgtttgccatattattctctgtacttttctgtgtgtgtgaaatttttttttttaaatcgcagaacagagccagaatattagacacacaaaacatacctgccaaataagtgagtggactggggatgcagcccttggaatgtctggctggactccccctttattctgccttccagaataaaggcgagcagggggcatcttggccattaggagggacactcctctccagccatgtggatg

SEQ ID NO: 1462 - DNA, 78 bp, Homo sapiens
gaggaaggcacaagggacagggaacctagtgacaaaacacagcataatttaaaataatcattgattgggggtagaggg

SEQ ID NO: 1463 - DNA, 93 bp, Homo sapiens
aataacaaccatctgacattctggaattaaaatccctaatggtctttacatgggaggtagcaagagggcaaaggaaaaaactagaggcgtgaa

SEQ ID NO: 1464 - DNA, 228 bp, Homo sapiens
gagaagggagggtagaaaattcaaaaccctaaaaagctatatgctgtttatctaaaacaaatgacccaggaatttaaaattgaacaacaaaagcagatgtattatgaaaatgttaacaaagcaaaccaaattaacatttcaagtagaaaaaaaataaggataaagaagattctaataacattatgagaaactttatatactcagtttaaatgtacgtggaatatttac

SEQ ID NO: 1465 - DNA, 269 bp, Homo sapiens
taattaaaatcaagataaaatgtttgatccataaatgcacaaattaccaaagttggttcagtaaggagcaaagctccatggaccattacataaaaataaatggaaaaataattaaaggtatacttaaaacaaaacaaaacaccagatccaagtagtttcgccaactggagctaccaaagctaaaaacaggtatttcccatgttatatagtggtcatagtccataaaacagattgaacaatttttcaattcgtaagaggtttttttttaa

SEQ ID NO: 1466 - DNA, 53 bp, Homo sapiens
ctataaagatcttggtgaagaaaagtatacagctgaattaaagttctcatata

SEQ ID NO: 1467 - DNA, 37 bp, Homo sapiens
gggaggtaagcataaaaatcaaatttaaagcactgga

SEQ ID NO: 1468 - DNA, 82 bp, Homo sapiens
tctgtatactaacaatgaatacataaaaatcaaaattaaaaaacagcattatttcccacacacaccagttccatttagcacc

SEQ ID NO: 1469 - DNA, 77 bp, Homo sapiens
cttttagaattttttaaatgttctttttaaaccagacaatacagagcatctggaactctcaaactctggagccctaa

SEQ ID NO: 1470 - DNA, 23 bp, Homo sapiens
tctatttctaatgtgtaggccag

SEQ ID NO: 1471 - DNA, 223 bp, Homo sapiens
tcaaaatgtgaatttaaaaattactgtgaaaaaatgtagactatcttggtaattgcacagtaggataggaaggtgtgaaaactcagacgctgtgaaggaaaagacttacagatctgatgactacaaaatattaaacttttataggacaaaagtcaccctaaacaaaaaattaggccatcggcttgtgaatatatatattcagcaaatattacagacaaaggac

SEQ ID NO: 1472 - DNA, 97 bp, Homo sapiens
gaagtgagtccgtagggtgggctgctgtgacaggatggatgacacatatgtgagtactgatagagtactgtgtaaatttatttataatgaaatgcat

SEQ ID NO: 1473 - DNA, 214 bp, Homo sapiens
aaggtacacatttaactcaacaaaatttggtcttactggaactttaaaaatgcaaatgtgtttatgttttgttttattttgcttaacaaatatcttggtattttactaagcttttaagttagtgaaataaagaggcataattcaaacatatttatacactttaaattaactaagcccaagtagaaaacaaaaaggtatataattcccaaatcat

SEQ ID NO: 1474 - DNA, 19 bp, Homo sapiens
atgagaatatcaaatggaa

SEQ ID NO: 1475 - DNA, 595 bp, Homo sapiens
gaataagtgatataatgtactatgaaggcaatacagtcaatataaatgcttccaaatagggaactggtgaattatattatgatacctatttatttacagtgaacctctacacagccaggaaattgctaatgtagaaaacatataatgacctgcaaatgttacaaactataaagcaaaaacaaggttgtatactgtaagtatgacatgatctcaatttcgttttaacattttattaaaaagaaaaacgactggaaggctcacagtatcagggtgccatgcggagggaggacagacatagcgaagcagtcctgaaacaacactcggtcacgtgtgaggacataataatgggtgttcagcctggtggctggacagctctgccttcagaccagctttagctgctatgtcttttcccctttgttttccagccttctcacttcctatatctcttggctccgtaacaggactgcctggtaatagctcataatcctttttcctgagtctagtgtgtaccattgtgagctatcactcttcccgtaaggtttatgtgatttctgtatttggttccattattgatgttgtgggatatcccatggga

SEQ ID NO: 1476 - DNA, 328 bp, Homo sapiens
actggaatttaaaatgtatcctagactggtaccagtagggacaggggaatttaagttactgacaagagtagttgaggaatagattggacactgacaataacatctcaggggaaataattgggggaagactagtgccaaaactacagtaggaatctgttactctgggacacagatgcagggttaattggaatgaaatgttactacttagtgtgtaaagggaggaaactttactaaatttcagtagatttctatgagacagaaaggatatgcagactggaaatcttctcttgccctttactatctgtgacttagggcaaaccccctagaa

SEQ ID NO: 1477 - DNA, 263 bp, Homo sapiens
ctgcttagaatccctatggacaggtaaagaaagttaagttagtgaatgaaggatctcaaaagatcctcactgtattgaagaacttccccattcaagggttgttagacaactgttaacatttaaatgggaatggctgtctggctgctcaggcaatgacctcagaggtgctgtccctctttcaatacattgggtctggtccttcatcttacagattcagtaaagccacagattgaggaatggggtaaaggaaataatatagaatc

SEQ ID NO: 1478 - DNA, 356 bp, Homo sapiens
agggatgtggcagacatcgttttgcctgtccaatagccccccacttcctggtcatagaaccccagtcagctttgggaagctgcccctccccagtggaagtggatccagggggctggtaaggtgtcctgtcaactctagggcaaggacctgggaagttgcactctgagtctggagtgggcagctgcccactgacctcaagagctgcagaccagctgggtcgccagcaccacatttctgatccttgcttttcaatagttcctttaattctttgatttgctgcatattttccaataaatcctgccgttctgaagttagctccagtagccttgcttgtaaagaaaaagaaaaagccacag

SEQ ID NO: 1479 - DNA, 202 bp, Homo sapiens
aagacaattctctcttgaagagtaaccaagagcaacagcaagcctgctgttcaaaaagtacatctcactctgcaacaaatcagtgcctactatgtaccagttcttacaaagtgacacgtcatctgatggagcaggtcattgtatcttgtgaatgctgaataaaccaacagaacactgatttataaaccataacaacttatta

SEQ ID NO: 1480 - DNA, 51 bp, Homo sapiens
ctcaacaatttattaattttaatgtaatcaacaaacaaatggattagaatg

SEQ ID NO: 1481 - DNA, 612 bp, Homo sapiens
gaacagaatactcttgtaacaaggtccttgagactgggatggatacccagaccttaggaaattgatcaaagttgggctattttatttggggattgcctatttaggccaggaagccctttcttcctgtcattataggaggtggctaattctatggttgaaaaggaaagagggagggatgttctgtgattgctgggcccaacttggaggtatgaggaggccaaagaggttctggggtaggaagagctgctcttgtcctgtggagggcctggaagttgggccccactggcctctgtggtctttgtcagagggagtggtagcagaggaggctggggctgtggatttgcaggattgcatgtgagagaggcagtcctggcagtggtggagtagccctggatgccccttagttcagcaggaggggaggtatggggtgaacaaacagttgtggggattgacctggattggggaacatttgaagctggctctcccaacttgttatagcagatgagccacggagttaactggctctcaaacaaatggatgccacccttatctcctgatatccctggcttctctacctaagattgcatcacccttacccctttcttcttatag

SEQ ID NO: 1482 - DNA, 162 bp, Homo sapiens
gaactttatttccttcataatattcgtgggaaaagaatcactggaaagtcttaattcctactaatttggtcaggaaggggcttaaagtccctccaaattgaacgttaatggaaatgtgatcgtattttctatccttaactaataaagactgccatattggtg

SEQ ID NO: 1483 - DNA, 138 bp, Homo sapiens
ttgttgcaggcataatcatagtagctggtgttaggaagctgtgggatagcctgatgaccatgcacgtgggatgggaatacatctttcaaggggatcaagaaacttagggagtatccggggcccttctctctcccatat

SEQ ID NO: 1484 - DNA, 20 bp, Homo sapiens
attggttgaatgagtttatg

SEQ ID NO: 1485 - DNA, 61 bp, Homo sapiens
accaggcccctggtggacagtgctggagacctactaactactgttgccactggtcttttac

SEQ ID NO: 1486 - DNA, 1463 bp, Homo sapiens
tggtctttttttttttttctaaactatacgtgtattccagcccttacaacacagagctctgcaagtaacagatgcccccaacttaaaaaaaaaaaaaatgaagcaaatcccagttccacgttcttctggagatacctcttccccttaatttgacgtgtctggctcccaagtctcatcaggaataggctgttattctctaaatcgtaactatcccttgtaaaagtagctaccactttaattcgaaaaccaggctaatattttaagtgtatcaagagaggctttttattgtcactatctgttgaaaccttcaataaatctgagagtattcttagaatcaacacataacttttgtgttttgtaagtttggaacgttgcctgttggattttcttagtgtggcacatgattgaagggagcatgttaaccttttaactaaaataaagtgtttttgcacaaatttagtgattatacctgagctggttaatgtgagagaaatgatcttaaacatgagcttactctcttgttgtggaggtaagacagacacaggctacaatttgataaccaataaaattgcttttgattagtgccaaaatgtatggagcagatattgagtccagtatttggataagataaaatatcttggaatattttgggactaattttaggatagacatatcatttttaggaatgtttataacagtccccatcaggagataatcccttctagaaggtttcttagatttgaacagtcttgtttaaaaagataaaagctcctagagggagctcactaaagggaatgtggttccctctagtggtggtagaagaagttgtgaattttcttatttatttctttttttcatatttattcattgcatcctgatacatagtagttcctgtattagagatacagaaataaaagacacagttttatttatcaaactcttacaaagttggaatagagaagagcaaataattatgatactgtatctgaaaatagtaaaaagcctcctagtccagatctggagggatggggttagacaaggaaagacttcctgaagaattagatgttatctgagtttttataaaaggagcacctattatttcttcctctatacaatagtaatgtattatacgggtatatttgacgtttattttggaaaatttgggaaacagatgagtttttaaaaagtccattattttcttcaccaaaagataaccacttacaacattttgctatatctgctacaagccactttttatggataatttatgttttaacagaatttatgcccatgacattttgtaatgtactttaaacaagttaatatattttgaaaattttcttgtattactacattcactagtataacattattcgttctcaaaatagttttcccctttttcccactgttactttttcaggtgaactttagaaaaattttgttcatttttaaaattccatcga

SEQ ID NO: 1487 - DNA, 197 bp, Homo sapiens
gggaggaatagccataactacattaaataatataggaacttttgtcttgctttttactttattcttgttttaccttaaagtgtaggattgtctgattttttttttgacatagatatttttcacattatgccttatttactaagttctctttttaatttggaataagtactaaatttgtcagatgtcttcttggtatt

SEQ ID NO: 1488 - DNA, 69 bp, Homo sapiens
tagacatatttttgtgtgtgtgtgtatgggccacaacacaaactactacagcatctattaagaaaggta

SEQ ID NO: 1489 - DNA, 20 bp, Homo sapiens
gcccaagaaagatatctttt

SEQ ID NO: 1490 - DNA, 123 bp, Homo sapiens
cctgaaaggtatcttttaacttgttctatagataagtctctcctccccccttctctcctctcatttctctttcttccagaaaaaaaaaaatccctttctctaaccccattctttctaacactg

SEQ ID NO: 1491 - DNA, 179 bp, Homo sapiens
tatagtatgtgctctttgtcgcccctgaacttctattatcatattacatcatatcttctttggccatttttgtgaccctgtaacttggaatcatggatatatcgctccctattttattcccagagattgatgcatcaaccaacatataaaaagatttatacatattttggtataaaaac

SEQ ID NO: 1492 - DNA, 577 bp, Homo sapiens
tctgttgaactgttctgttcttgtaacaaatggcagttagtcatactgtgttattcttttactatagtgtttgaatttgcatattagacattttattagattttttgcatctatattcaaaagcaagtatggtcttttgctattcattactttggtttagggagcagagataagctagataaataagttgtctgtcttctggaagtgttaagtagcatgggaggtatgtgatacttgagtgcctaaaagagcttcatcatatagccatctaggcccactaacctatttcaagtctggctaaacatctcccaacttttcatcattattggtttttgtacttctgtcttttgagtttttctacttctttcttgaagaaaggtagctcgttcatcatatttcgattttcaaaaatttgatatgagttgtatattgaaatctcttacaatttaaaaatctatttcatagttccaatgatgtcttctttctcattactaatggtgtctttgttgtttcatctttttcaagtttaattttctgcagatttttttcattagatttttaaaaattaggtaattaa

SEQ ID NO: 1493 - DNA, 78 bp, Homo sapiens
atcagttttagaatgttttcatgagcccatagaaagatccctcatgtccattaaaagttaattcccattcccgtcccc

SEQ ID NO: 1494 - DNA, 1010 bp, Homo sapiens; identical to SEQ ID NO: 467

SEQ ID NO: 1495 - DNA, 462 bp, Homo sapiens; identical to SEQ ID NO: 468

SEQ ID NO: 1496 - DNA, 1342 bp, Homo sapiens; identical to SEQ ID NO: 469

SEQ ID NO: 1497 - DNA, 236 bp, Homo sapiens; identical to SEQ ID NO: 470

SEQ ID NO: 1498 - DNA, 267 bp, Homo sapiens; identical to SEQ ID NO: 471

SEQ ID NO: 1499 - DNA, 1168 bp, Homo sapiens; identical to SEQ ID NO: 472

SEQ ID NO: 1500 - DNA, 539 bp, Homo sapiens; identical to SEQ ID NO: 473

SEQ ID NO: 1501 - DNA, 964 bp, Homo sapiens; identical to SEQ ID NO: 474

SEQ ID NO: 1502 - DNA, 42 bp, Homo sapiens; identical to SEQ ID NO: 475

SEQ ID NO: 1503 - DNA, 322 bp, Homo sapiens; identical to SEQ ID NO: 476

SEQ ID NO: 1504 - DNA, 6677 bp, Homo sapiens; identical to SEQ ID NO: 477

SEQ ID NO: 1505 - DNA, 169 bp, Homo sapiens; identical to SEQ ID NO: 478

SEQ ID NO: 1506 - DNA, 67 bp, Homo sapiens; identical to SEQ ID NO: 479

SEQ ID NO: 1507 - DNA, 275 bp, Homo sapiens; identical to SEQ ID NO: 480

SEQ ID NO: 1508 - DNA, 1357 bp, Homo sapiens; identical to SEQ ID NO: 481

SEQ ID NO: 1509 - DNA, 21 bp, Homo sapiens
atgatcataatgcgttatcat

SEQ ID NO: 1510 - DNA, 19 bp, Homo sapiens
taaaaatctaccaagaata

SEQ ID NO: 1511 - DNA, 505 bp, Homo sapiens; identical to SEQ ID NO: 484

SEQ ID NO: 1512 - DNA, 300 bp, Homo sapiens
tggcaaagagtttatctaaaaataggtcactcaccaggattgaagaggagataactgactgagagatagtaaagagacaaattcagtgatattccaacatggattagatggggctagtaagcacatctccccaactagagttccagcttctgagaaacgatgactatttctttataattctgaattctacaactgacatattatagagacttagtgaatatatgttgcattaaaagagcagggtttctaactttatctactgagtcagtaatagcgttatccaccaagatatgtaataca

SEQ ID NO: 1513 - DNA, 107 bp, Homo sapiens
aattgggaaactatctgcatgcatggcagaggctgtcaaaattgtgcaaacagataagctttcttagggagcatagactgaaaaaaaagttgaggctcaagaataaa

SEQ ID NO: 1514 - DNA, 508 bp, Homo sapiens
caaggttttctgataaagttttatgtctggaaaaccggcccggggtgaaatacagagcttgcattaaatgaggggccttcaggaagaaagtctcaggcactgggatgggaggcagggtggatgcagaaaatatattagaaaaaacaagtgggagggtagtggttaagggccttgagaaaagttgtgaaggtttcaaatgcaatgcactgtaccatccatgtggcagatctgttctttcacattctcaaacaatcacagtgtcaggagtgcagcttcttccagtaacaatggaaaacagtttttcaatagcccaacagagtatcacactcttagcttcaaactggatcatgaatgagtggagataaaattggatagaagagttctgacattttctttggcaatgttgtcacttcatatacacaacaccagaatataagtgaaatggatggggcagtacaggattcaggaaactgagcttttaactgacgtaaataataacagtaatgat

SEQ ID NO: 1515 - DNA, 280 bp, Homo sapiens
cattctgagtaattttagtcattgttttcataatgccaataggtttatacggaagcatacacacatatatgtacatgctcatagaagtctgattttataatgatacactgctacctaataaaggctttccttgacattccatgcaacttcaaattatttttatttggaagttactactgctccaggatatgctttattgctttattagcaccaaaattgcttttggtcattttttttgttttctgggcattttttatcccatccaaagtcagtctgttcc

SEQ ID NO: 1516 - DNA, 164 bp, Homo sapiens
acaccgaatgtgtgggttagatacagaaagtttttctgtcttattaaggagtttggattttattcttagatcaccggtgtgacaaggaggggatgtgggatcaccaagacttaaaaccacaggaatgtatgatcataagtttattgtgtgtgtgtgcgtgtgtg

SEQ ID NO: 1517 - DNA, 28 bp, Homo sapiens
cataatttaatttttgtagaggaaagtt

SEQ ID NO: 1518 - DNA, 396 bp, Homo sapiens
acttgctgtcacacacgtgtacacacctcccaccagtgttccatctccttctagcagaaaccccatcaatgaaaagaaggtcaagagatcacaaacagaaactgacaaggatttttcaaaacagtaagttattttatttcaaaatcaaaaatatggcacaatattgatcccaacaggaatttttagctggaagctgtttctaaaagatgcctacaatttcaatagaccacatctcccaggtgattgcctaacccctgggttagtgtgagcccttctctcctgcttctcacttccctttcaaagtgcgtgagtcacacccttttacctgttgtcttcattccctgccccagctgatagtgaataaggaagacagttgttgaaacggagaaaggaaag

SEQ ID NO: 1519 - DNA, 896 bp, Homo sapiens
catttcttttttctctgtgccaggcactagggcatgggctagaagctgagccatagaaacctgctttgggtcacagagcatgatgggggagggaattgaggtcagattcttcggctcatgcctttaccactacatcataaacagggctgggtctctgttatcaaggtctttcattgttggcacccgtgttcacacagcttgccgagtttctagttcgctggctggctctgcctttccctcccagtggcattctcagtttatggctgcctgccctctccacttgggagtcctcatgttactttgcgcttgggtgtctgtagcctcctgattcctgcctacccacctggatacacttcttctttggtttggggccagctgagaactgctcacctggctgtagtgtctaagctccattttgtcccctaaaccgcctatttgccaaatatagccctggcaggactcagtctcttcccagttccgaagcacctgtcacactctccaatccaaagcctgccagtcatttttatcatatcctttaccgagagaaatctttagaagctgctctgttttccttatctctaccatttagtatttttttaaatattgacttatttttccaaattaagtcataaagagatgcatgatgaagtactcatgctctctgtttttattaaagacttaggatcaaattagatctacttttttttttttaacaaattgaatacagacagtaaaaaatacatttgtgggtaaatttggtttaagcatattgtcagaaaattacaagactatgagattcctgaatgggcatttagcctaccttttacctccaggcaggaacatggctaacgtttactaaaggagagagagagaaagagagcgattccattatgtta

SEQ ID NO: 1520 - DNA, 183 bp, Homo sapiens
actttaggagataaactatctaggctatccttcacctagggccattcgtactggtgatcactgtattgatgaaagagtctgagatagacagaaagcggggtttgaataagttttataaggaaagagtttttccagtggcagttaccatatttttaaaattcagtatgtaacggccaaaactac

SEQ ID NO: 1521 - DNA, 549 bp, Homo sapiens
caagcaaacaagagagagggattaagaaaaccacaatgcacatataccatgtaacccatcttccctccctggaactcctcactgatttcccaatccagccactccaatttcccaatcaaggagctatgactttgaaatagcgatggtgtagctttagccccgatatatgaagtgctcccactttttgccagtcacttcacagttctccctttatttgccaagatagacctcctccctctaagtaaaataaaagtacggcttttctaagttaacctaaagaaaataatacaatgcctgtgttagtacatgactttttttaagcaacagaagactggtaaagaggctgttatttaaaactgattgaaatggattcagagtacaggccctgtgccaggtggcatgaacttgtaacccatgcttaactcagatttattatattaatcatggtaatccaatacatagtaagtttaattttgtgtgtatgtgtgtgttattaaagttgtattcaaatgaaaatactaaaagctgaagaacaagcacagaaattgt

SEQ ID NO: 1522 - DNA, 239 bp, Homo sapiens
ttatatttttattactaattataataagtttctccttcttgaaatttggatttagaaatttagagaaattcctataccctttccagctaaaatatatattttttgtgaatagtgtattcagtaataagagcctcaatgcagaaattccagaatgagtctgcttatcattttgcagttacttaaaaaataaacattcttgtgccataagattccttggctgataagttagatctgtagtt

SEQ ID NO: 1523 - DNA, 53 bp, Homo sapiens
caataataattaagacattcaatagctcgacaattagaaaaaaataaagtatt

SEQ ID NO: 1524 - DNA, 25 bp, Homo sapiens
ttaaaatttctttatattttaaaat

SEQ ID NO: 1525 - DNA, 105 bp, Homo sapiens
caagacttacaatcaagtttaaaaaaccaagacagtaggatgttataagaataaaccattgattaataaagcagaataaactgattctatttctctctctctctc

SEQ ID NO: 1526 - DNA, 22 bp, Homo sapiens
tattgttaaaagccaaaagaac

SEQ ID NO: 1527 - DNA, 577 bp, Homo sapiens
gtctagctgcaaaaaaagtcatctggcaagatttgtactaaatggaatgagataataggaggtgaaaggaaaagagagagaagaatgctggtgggaatgagagttgacggggaaaggtttgaggggaaatggaatctagagaatgaaaaggaattaaccctggatgttgacattaccactcttcaactgatatgagaaggaagaaacaaagaacacatgttctacccttgtgttgctcacaactcaaggagtagcagtgtgtatcttgctgaggagacattactcggagatctctaaatctcacagcatttgaatactatccaccccgacacctggtgtggttgcatgcgtgtgcatgtgtgtgtgcattggtgtgttgtagtgagggaaactatccttctcaatgagatgttactatgaaaaaatgacatttctcatgaggaaacctgacagctttgaaggtatagcatctatgggagattctcaaaccaaacttagagattttaaaacaggggctaccaactcaatgcctacaaggttcagatggttaataataacacccacagtgtattgagca

SEQ ID NO: 1528 - DNA, 577 bp, Homo sapiens
ctttaaacagaactgtagtctgctaagggtgtccaagataaacaggagtatacattcaaaacaggaagtttgataacttcagaagcttgatgtatgtgaaaacagaatttttaaatgtacaatataaggggtaaaagtacacacattaagaaacaagcaacctaacaaatatgcatcaggaagaaaacttggtaatagcccaatacaaagagaaaaggaagacattttaaaataacaaacaccaccaacaagaatgctgggctgctgcactgacaaggacagttgagatgagacatcactctccaagaaagttaaatgtgatctggaagaatacatctcttgctgtgaaaatcctgtcccacttacatcagacatactgtattcagtgagacattaacaagtaaacagcaaatccacatctcacagggccattggaagaagatggggaaaaacgcagatcgatgtgggcctaaatacatcccatctttaattattttaaaactctatcagactttctcccaggcagatgcaaccaggaaatgtaaatggttctagaaatcattaccaaaattttttt

SEQ ID NO: 1529 - DNA, 107 bp, Homo sapiens
taaaataccattttgactattgagttattatagcaattcttttaaatggcatcatgtaatacaagttatcatgcagtgaaactggcattcgcacccatgactgacac

SEQ ID NO: 1530 - DNA, 107 bp, Homo sapiens
cagtaggtaatctcattcattttttaaaaaaatagcacaggaaatgcttaaaatatctcataaaagaggaaagaaaaaggatgttcagatctattaccgtggctgtg

SEQ ID NO: 1531 - DNA, 93 bp, Homo sapiens
atcacacgccattatctaacatgaaacctgaaatgccataattagatgcatttatttacatcttgaaaaatttgataatcaactcacatataa

SEQ ID NO: 1532 - DNA, 232 bp, Homo sapiens
ttcatgtaaagatggcttgacaatggatgaatggatgccttagttatataaatggcaagtggaaagtggtaggtagcaggtaagtagcagaaattttctttgaggatgtatcaattaaggaccccatttgcaatgaatagaaacactctatttacctgctgcatacataatgaaagctgtcactggagcagctgccactgcaagttgggtattttttctgcagagcacaaat

SEQ ID NO: 1533 - DNA, 21 bp, Homo sapiens
gaagatgtatcactcaggacc

SEQ ID NO: 1534 - DNA, 53 bp, Homo sapiens
tccaacctaagccagctcaaacaagaaaatttattgagctgttgaactgaaaa

SEQ ID NO: 1535 - DNA, 243 bp, Homo sapiens
agtttggcttttctctccagaaagtctagctctacaagatggtctctggcatatctaggttcaagaaatccttagagcaccaatccagtggaaagagtttatctttcccaaacattgctacagcacaggaacctcagaatttaatctctcaggatggatctggatcatgaatagaatatgaaaactggtcagggctccactatgttcttacccttggaggcaacaacagaatttttcctaccc

SEQ ID NO: 1536 - DNA, 371 bp, Homo sapiens
ctcaaaggataacttctgaggttgttaccagcttacatcatgttgaggtgcagttgaaagggagactgtgttgaactttacaggaattagatgtagtaaataataggtgggggtggacatgaaagaatgaggaggagagagaagaagaagaaggctaatgaataagtaggaagccagaaaacactgactttataaatattcccaatgtctgctggcactgacctagactaacagaaggggtcaaggtaccactcattccatgatgcacatgtaagagcctatcctaatgcaggtaaataggtagatatttgagaagtcagaaataaaacatatgcaccaggcaaacatttgcaagagatgccttataatca

SEQ ID NO: 1537 - DNA, 886 bp, Homo sapiens
aacttagatgtgctattcgttattcacagcttcacaggtgatgcaaatcaaatcctgctttttgttgttgctgttttttatctttctgcttgggattcatagacccaagagcacagatatgattggcctaacttgggtcatatggtcacctcttggctaaggagcattaatgaatgcatggataggagaaaggtatttccccaaaggcaaaattgctctgctggtacaatgagaagaaatagtggctactgaatggttctgcaggggcataggttgtaaggtgcacagcaggaatctgaaaacagatcaccagaccaagactcttccacagctgcccgagaatatcatacctagagtgatatgatgtatctaaaacagtactgcatgacctattcacagcccattttcaaacatttctgtctgcactactgaaggggctaaaaggcacaaactgcctttgaagtacccagcaagaattacaaaccaatcacgatgacaggaccaaaggtacctgcatctacacaagcgtgcactgttaccacactggactgggtaacagttcactgggttgttcctgtctggaagaaactgttcattgcccccaggagagttctattttgtactcataaggcaaaattgtcttttgcggctgtaaagaaactctcttagttgccagcttaaccatatgctacacctcctacctcttacaactctttgttaaatcccatgaccttctcaggcaaaggttccatctggcagaattgctaaaaccacaaaaacaaaaaagccagcagcaacattaaagaaggacagttttatggatgtatcttgtgtgtagatgcttctctaagattttacatgtattgtttcttttacgatgcaatat

SEQ ID NO: 1538 - DNA, 92 bp, Homo sapiens
tgagctgggtcttcacttcccagattcctttacccatatagttccagtttaagttcagccacgggcaaatctgagtgagatttggtgaggtg

SEQ ID NO: 1539 - DNA, 92 bp, Homo sapiens
aaagagtttatctttcccaaacattccaacaggacaagaacctcagaatttaatctctcaggatggatctggatcatgaatagaatatgaaa

SEQ ID NO: 1540 - DNA, 452 bp, Homo sapiens
atgtaatagctgaattaacttccatagcatattgccatagcagtttttatatgtagacacaagtattatataactgtcatatcagtatatataaagatataactaatgtatatcatatatatcatataatgcatgcattttgttagtagtatataagtttgtatatataaactatagaactgattagatagatataaacatataaatatttaccctatatataaaatttagctccagaatttcatagaaactggtttttcaatgttttccctggtggatatcaaaaaatgccaactgtgtgcaattgaaaattctcaattgtatacagttagtattttgatatctgctagtgacaacagttgaaaaaccagtttctataaaacactggagccaaactgtcatataaacaaaaagatgagtggatctgcttctttggataatattggttattc

SEQ ID NO: 1541 - DNA, 469 bp, Homo sapiens
aaagaaaaacagaaagagattgagctcattaacgttcaaatgaggatccatttgaacagagaaggttaatgagtacacagtgtgggaggagccctgagatagtttaaggccatgaaacaaatgcaatgtttagaagaaaatgatagataattccacttaatgagtacacagcagactaattattgcaatgaaaaatgtttaattaaaaagaagtctgctttctaatgattatactgactgtaaaccagtttaaaaaatcccaaagacagctaaagacaatatatataaagactgcagggaaagtttacacaaagaagataagtatatttgtttattattatggtttaaagttagcattctagcaatcctggcctcttttaatacaatgtttcctgatctcttaagaaaacacccagttgaacatgggagaagagattacttggaaacaaaagaaagtcatagcagaatc

SEQ ID NO: 1542 - DNA, 302 bp, Homo sapiens
cagagaaaatatattttaacacaaatttgttttaaaaatgtgaaattatagcaaattccattcaggtcattagtgacagaatccattcatggaatcaaaatatcaaggaagcctatacagctccagtttgcggtgggacttgagaaagacagataaagaatattttcacattctgcttcacttcaacaaccaccagtgtctcgatggacagggcatgcaactggaagagagtagaactaggagtttcaagacagggctgcaaaatgtgactctttctgcctctgatttctctgtgagcataa

SEQ ID NO: 1543 - DNA, 119 bp, Homo sapiens
tatggatagtgttatcagttatcaatttcagtctgggggaatccataatcattcattttctgggccttttcttcccttgacttgcccacttctcttccccttcccagacaaatagagag

SEQ ID NO: 1544 - DNA, 242 bp, Homo sapiens
gatagaggccatcatggggaactgagccatggtgggtagattctatgtttagagggtggcacttaagctctgactgctgttggagcagaggaaactgataagagatgagtctgcagaagaaaacccaaacagatgtgagatcagtgcactggtattctgaagaagccagtgagagagaagtcaaggctctggctaggagctgttgagatgagaatttagaaaacccaacaaaagcagaatgt

SEQ ID NO: 1545 - DNA, 1432 bp, Homo sapiens
gttatctgtttatctttgtgcttgtaatataaatgaaccagtggcactttggaatgccacatgcagaatgaatagaaaaagtttaaaatattggtgcaggaggtcaatcagaaagatatatatccattagaatatctagatatgagatgataaagacatggaataaagtaatagctctttatttcttcccaaaaatgttcaattgctctccttgaagtatatccattttctaaatacttcctctttattctcctgtaattcagtaggatttaagaccaacagaagtattgtgtatttctagtgtagtcagtctggattcaagtcatttagaatgttatacacagttggttcaaccaccctactatgtctggaattgtcttctccccagttgcaacttttctctcacttattctctgcctccattgggaacacagctggggtgagaatgggaatgtttgcagggtgatccaaaccaggcctgagcatggttctgccatggctttaccccacgaaggctccagtcacacccacgcccaaggaatctgtaggggacatggaaatccagcttaaagaagtggcatttatgtttctgcatgtttgtttactagggatgtaacacggccatttagaggagactagcactttgcagcaggctccttgaaagaagagatggaccccttcatcgcagttaacctgccatgccaaacaaacatgttcatgggcatcactttctcagtccaacagggccgttggagcacagaagccaggcagacacaagcggtatgttgaagtcagaagtggtctgattcagggccagggtgggggtgatgtaatgaagtgccgagggcacagaccttagggagacactcactgtcacggttgtgcaagtgcagcatctccttaaatcttgtcccctgtgtgtcttgtcttaccctagttccaaaacacatctaacttttcagcaagagagaacagatgtcagtcatataaatagcagaaatgagagagccaagaaaaagaacagctttgtgttgaaaagaagtgtggttaagaatacacagcatttgaggtaacaagacttcctctggatagggactagggttttctctgcatccaggctgggaatcccgagctcagaagagatggtggagatgtagggttcagagacttttgcttgcttttcctaactcttgctagccagaaacactctgcagtttcacttttttaacctttggattcatcccattttagtcctcttctatgccttaaaaacactgaagatgagaagatcaaacctgatgaaagtcatgttctgttttctgtgctttcatcatccaacatcaatagactctgacgctgtggccttgtgtggtgcgtctgcgttcgttgtgagtttcaaagctgaagaaagttagtgggtgttggcatgttc

SEQ ID NO: 1546 - DNA, 2725 bp, Homo sapiens
aagttagtgggtgtctttcccactcctgttcttcagttgcggtttttcaaaagttggcagacatgtttgataaaattctatcaaagaagtcatcatgatgacattagggtgtcttcctttatgtttttcgtctttattcagtggttgtgtgtgatgttccttctgctccatttttttgttttgttttgaatttcatgatgtaccatgcgggagtgacccacagttccagatgattgattaaaacccctcaggctcacactgctcactgttgacacatcccttgagttttgaatgagatcagttacgttcatctccactgcattctgccttcttgtcttgctcccttcattatttacttttctgcccattcttttatgttgataactaatctgtgttctttaatcttattacccacactaacacagaataacattttaatgttcaatttttaaaaccattctactttaaggtgtaaactcttttcacctgctaaacagagcgcagccgtatttcagctaattaacccacagcatgtatacacctgataattcaatcgcacatttggcttactgccttttaaaggctgtcttagagagggattcctattaaaattaagaagagttttgaatttgaaatatgatcaagtcctaaatgttagagctggaggaaagtgtgtgcattattttatttgaactcttgcgtggtatatatggagaccaaagtgctggcacgtgctcactccaggtctgtcaactcagtagagccactaccagacttccagtctcccaactcctattccaggagtttagctctgagaaaagaaaaacaaaacaagacagaaaattgtagtcaatgtatataatgaactaattgttcatacatttatgcacaacatgtaaaaagaaagtacaatgagcttgaccttaattatattaaataagtagaaaagagttcttaaaatgtaccaaatggcagaatgcatcatactggaaaatgtatttatttagtacatacctaggagaagcttttcagagaatttgcttaaaaggcagactcttaatacattttgaacatatttcacaaaacaagtttatccgaagaaaatcttatagtaaaatacaaaacaggacattgttaacaacactgaacacactgagataacattctattactgctgccgtggagtagaccagaaaaatctgcttatgccattgcccatgatatttatgataattatttaagagaagcattaactgggggaatggacagcatcttatctactttgtaatagcagtgtttaacgggatgtccctgggtaatacagaggagacactctaacaacaattattgaatcgataggataaaaaacatagagaaacagacatcaagagctcagaacaaatggaagagcaaggggccaggatgtaaggagattaataagctttggggattggggtgggaagtaaaaataaatttcatctgcttcctcattaattttcagtagaaccaaccctgctcatgaaactggattaagatttcacgtggaaactatcaagttagaggacttcaagagtgtcagtgtggtgatgcactcacaggacagggcaaagctagcactcatgttcaacacttgagatagtctctactgggaaaatgtgggataatgtcctcaatccaatttgaatgggaaccatgttgagaattcctggtacattgtatatagaaaaataattaatacttcctagtaggcatttaatatcttatagatattatagtagaggttttgaatactcatttatgtctgacaatattcaaataatatatttaaatatagcagctataatttattgcccgtgtgcccagacagtggacagtgtaccaagaagcactgtaatcaatattttatatgaataatctgatttatttttctcactaaactccatgaaatattttattcactttattttgaagaagagggatgaaacagttgcaaagcatctatttgtttataaatgtatcacaaagatattcagcccacactcagcagaagtttgaaccactgggggacaagatgagaagatctttcattttgagacgtgtccaggagcatttccctggactgtgagaagaaccatgctgcctgtctgtgctggggaggccagagtttgtctgaaccatgaacttgccaggtgcaggcctagggctacactcagagcactctccagacaggagagagagcagccctgctctgcctgaactctgcccagcagcatagtccagctgtcccaagagtgcagctctcaacagttattcctcctaatgctgtcactgcttttccaagtgttggtcctttggaaattagttcctgctgtcttatacacttgaaggcacatgattttatttctataaagagaggcaaagtatagagtttatacctagttaagttggctttttctccaattaatttcacttaaactttattttgtactagcttcgtattaaaataaataactgtttctggaatttttcacactcagaaaaaaatggcattcatattagaaataacattagagtattttgatttaaaatagtttgaaactacattttattaaaatatttgaatcctttaaggcacagcctagcaccttaataaaaaaattgaatatctcccaatattgctggttatgcaacataaatgaataaaagcttactgtaagaaaaaaaa

SEQ ID NO: 1547 - DNA, 1060 bp, Homo sapiens
acctgccatgtttgttttatgtttttggaatcagaaacaccaatcagtcagggccctttctctgcactgtttctaatcatccatccccatcatggcaatacagcctcatctggccccagtaacctccagttttcacagagcttcttttcccatgtatcccctctcatgagaggctcagcgttaaattcaaatgctctgtgttactgcccacctcctttgagagggaagatagcatgagctcattgaatcctcttctgcggggtggcccaaaacctgaaaatattacggaatatccataataggtgatttattgatacaccattccagttcgtgatattacatggcatgagatacgtaatggtgttgatctgcaatagcaacaaaaagtccaagatactgtgcaaaactacagtcaccatggtgccttaagacacaccttcatcaacccctcagatgttccccattgagacattgcctcagatgattggtgcctctgattttcattgaataaacccgcactttttgcatattccagagaaagtaatcacgagggttctgagctgaggagcatgcagcccactcctcagggctacattgtccatctcagttttggaaattaccaaccatctggttcctccctcccttgaaggaacgggtggtatatcttctgcgggaagcactccaggaggtgtcccttagctcatcaacaatgagtgttattgcaacttaatatgtgaaatatattaaacacttgtttatttttccaaacttttgtccaccctgtgttaagtagaatgcccatctgatcaatgaagttcaatcatgattttccaagtaaatgaaagactcagtgagttagttcagcagtcagccaattcatcagaaggcaaggtctgtgtttcttccataaaagttagacctaaggggtaacagaactggacccattcattagtgagttttatgaaactgttttcattatgtgtggtgatgaccacctcacttgctacctcacaggttttacatacggcagcaacaaatgcagcaccacacttttctctac

SEQ ID NO: 1548 - DNA, 472 bp, Homo sapiens
tctcacatctcccctagacagatattagtggagaatcttagttttacacttggctgccctcacacggagctacagtgtgatgactgtcataagcagtggattcacaggctactgacccattaggaagtgctccatttaatctgaaagcaaagctgaatacgtgagcacacattacacaggaatttatgccctgcagcatgaacaacaacaaccaaaaacaaacctaacttcaaatgtttaagtcattggcaatttagctgactgtatgttctgaggaatcaggccatgagtgagtaaaatataatcataaaatatttgataaaatatccaatctctatcttaaaagcaatgaaattctgatattttaggagagttttgtttgttttttcaaataaccaactatagattgtttggatacagacctttcgtaatacaaaatagttcattcatttttgaatatttctgcttattt

SEQ ID NO: 1549 - DNA, 1132 bp, Homo sapiens
taaaatggctaagtctttaggagaggaagagtgaatagtcattcctcctttcatctcatattttaaacaatactttccttccttaagttaaaaacaaatcttttcccccttaagttaaagatttagcaggtgtcgtggttaggacacagggtgattgatgtgtgagaggagatgagtgggaagactcagggtggggccgactcttttccagactgtgtgcaggtagaaatgccatcagtcatcgcttcctctggacagactaatttttgtctgtctcttcatagatgcccatgaggttactcaaagccccatatcggatttccctgcccaggacctctgtttccaggactcttcagcccacatctctgacccaccgttgcccttgcaccgggtttgtaatgctgatcacttccaatcagcaaactgtagtgcttgagggcctcctgtcctctgcccttgagtcagtcgtttccatctcaaaaataatcacaagggaactgagacacacagccagtgtcttatgacatcattttcccccttccttcctatttccccaccaggaacaggccaatatagttgctgcttattaaaagtttgtgggaagaaaaataaacgcagacggtagtttccctaaatcctaaatgtttctacagactctctttgaattatcaatttgggaagagcgtttagaagctggacctggaactttccaggaagctggcttaaaccatccttacctgtctgtccactactagagcagcctccagaacatctgcttcagaggccaggagcgctctgcgcagcggtgcaatcttcaggttgttggcccaggaaatcttccaggactcgccattcccattcttcaaacaccttcaggcagtggctgcatattgttcccactcaacttgccctcctatcttggaaatatattttcattttcttatgcttttatttaattgtctgtgttcacgctgttttacctcagtacgtagctgcaaaccttgtagaacgataccatataaaatagttaacatcctcttggcagcactctcaacctctccatctcactgagaaacaagttgacataccaggttggagatcaacacaaactaaccaagaagctacactgttc

SEQ ID NO: 1550 - DNA, 1170 bp, Homo sapiens
atcacactttaaccgagattgctacctaagtaactttaattgctgaagttgccttcatggaaagccctcaggtaacagcaattataaaggacacatttatgaccaggtaagagtctatccacatcagcagagaacacaatgactgttgtttaagtacttcagtgtaacagaaacaggacacacactgatgcatgcattaaaatgcttatcatccatgacctgtgacggtatctgatttgggcagctacatttggggattggagggtaggtgactcaaccaatatgtggcttaatcggggcacgatagagtagagaaacaccctgaaaggccagagtgaagtgaatcaaaagacgttctgtgattttgggggcaccaggattctcccatggtccctggcttcactttgacactgaagtccaatggttctgatattcccagaacatctgttgcagcagttagaatcacctatcttagttctccctaatccacagcatgtgcctgctgaattaactgctgttgacatcgaagtgcttatttcaaaagactcttctgtgtgcaaagttcaatcagaaaaacacagcgtagacttctgccttccttcaccaacctcagtctaaggataggttatttctgatcgaaaaatctcctcagacttgtgactcctccagtgtaaacaaatgttgctgttcctttaggacaaatgatggattgactttatgtttgatgctatcgggccagaaaatacttgcttgtaaatgtgacattcaaggtgttatcttggtcagcctatggataagatggggacagaaggcgtaccaggctttcctcttttctacagatcctttttgctagagctattccttttccttgggatcctggcagttcaccatcaccatttagttttctagaaaatccattaattatcacaaatattatttactttctcagggttatgctagaatattgtttaaatctgtaacaaaagaaactcaggctccttgtgacgcttacatgtgtaacagaggagttttgtaaaaaaatcaatctgtaggcattgatcagaaatgcaatatgctacaaagtttacctctactgtctgataccctatcattaatctacaacaggattgtttaaaaactgttacaaactattagtaccccattctgtaa

SEQ ID NO: 1551 - DNA, 635 bp, Homo sapiens
gctaaccccatgacatttattcagtaatgacagccacaatcacccttggttcttttggctgcagtttaaaatcaaccgtgactgaaggtaggattatttagcaggagaaacgttggcctagaaaatgtgtgtatccagatatttaacttcctaatgttttccattcattaacaaaacttatatacattatttgccacaacctattagtttttgcagtctgagaaatagagacaagagttatatgatcaaatcccgactgccaggacttgaataagttatttagaacctcaagttagtttgtttcttttaaatttttgtagaattagctgactttcgggttgcccgtgcacattagaacaaaggagtataaaattggcagaggaaagaatagaacatgaggcagcactgtctcattcttatttactcagggcacagcccagtgactttaggcactcaataatcattttctgtataaatgaatcaatatttgtggttaacactttataaatgtcaactgttattatcgtttaatacatcattgaatgtcttattactcttaatagaatttcaagaaagatacaattaagttaaatcaggatttatttgggataagctaagaattattattattatta

SEQ ID NO: 1552 - DNA, 241 bp, Homo sapiens
attattggccttaatttacaatcatggatataccataaaaagagtattagtgttttagaagtactgtatccatttgaagaatgacgggtgactaaatggtcatgggtcttcctcctcatgtcttgctgtgtgctgttccgactctcctgcaatatggatcagactctgagcctatcgtatggtgagactcccaggtggatgctatgtctaaatacgatgggtggttatgtgtgcacaacct

SEQ ID NO: 1553 - DNA, 570 bp, Homo sapiens; identical to SEQ ID NO: 485

SEQ ID NO: 1554 - DNA, 61 bp, Homo sapiens; identical to SEQ ID NO: 486

SEQ ID NO: 1555 - DNA, 211 bp, Homo sapiens; identical to SEQ ID NO: 487

SEQ ID NO: 1556 - DNA, 13 bp, Homo sapiens
ttaaaataaaata

SEQ ID NO: 1557 - DNA, 493 bp, Homo sapiens; identical to SEQ ID NO: 488

SEQ ID NO: 1558 - DNA, 69 bp, Homo sapiens; identical to SEQ ID NO: 489

SEQ ID NO: 1559 - DNA, 31 bp, Homo sapiens; identical to SEQ ID NO: 490

SEQ ID NO: 1560 - DNA, 716 bp, Homo sapiens; identical to SEQ ID NO: 491

SEQ ID NO: 1561 - DNA, 125 bp, Homo sapiens; identical to SEQ ID NO: 492

SEQ ID NO: 1562 - DNA, 1072 bp, Homo sapiens; identical to SEQ ID NO: 493

SEQ ID NO: 1563 - DNA, 67 bp, Homo sapiens; identical to SEQ ID NO: 494

SEQ ID NO: 1564 - DNA, 59 bp, Homo sapiens; identical to SEQ ID NO: 495

SEQ ID NO: 1565 - DNA, 798 bp, Homo sapiens; identical to SEQ ID NO: 496

SEQ ID NO: 1566 - DNA, 353 bp, Homo sapiens; identical to SEQ ID NO: 497

SEQ ID NO: 1567 - DNA, 464 bp, Homo sapiens; identical to SEQ ID NO: 498

SEQ ID NO: 1568 - DNA, 151 bp, Homo sapiens; identical to SEQ ID NO: 499

SEQ ID NO: 1569 - DNA, 21 bp, Homo sapiens
aattttttttttaatatatac

SEQ ID NO: 1570 - DNA, 1212 bp, Homo sapiens; identical to SEQ ID NO: 501

SEQ ID NO: 1571 - DNA, 496 bp, Homo sapiens; identical to SEQ ID NO: 502

SEQ ID NO: 1572 - DNA, 233 bp, Homo sapiens; identical to SEQ ID NO: 503

SEQ ID NO: 1573 - DNA, 255 bp, Homo sapiens; identical to SEQ ID NO: 504

SEQ ID NO: 1574 - DNA, 354 bp, Homo sapiens; identical to SEQ ID NO: 505

SEQ ID NO: 1575 - DNA, 169 bp, Homo sapiens; identical to SEQ ID NO: 506

SEQ ID NO: 1576 - DNA, 110 bp, Homo sapiens; identical to SEQ ID NO: 507

SEQ ID NO: 1577 - DNA, 71 bp, Homo sapiens; identical to SEQ ID NO: 508

SEQ ID NO: 1578 - DNA, 703 bp, Homo sapiens; identical to SEQ ID NO: 527

SEQ ID NO: 1579 - DNA, 108 bp, Homo sapiens; identical to SEQ ID NO: 528

SEQ ID NO: 1580 - DNA, 223 bp, Homo sapiens; identical to SEQ ID NO: 529

SEQ ID NO: 1581 - DNA, 82 bp, Homo sapiens; identical to SEQ ID NO: 530

SEQ ID NO: 1582 - DNA, 660 bp, Homo sapiens; identical to SEQ ID NO: 531

SEQ ID NO: 1583 - DNA, 176 bp, Homo sapiens; identical to SEQ ID NO: 532

SEQ ID NO: 1584 - DNA, 431 bp, Homo sapiens; identical to SEQ ID NO: 533

SEQ ID NO: 1585 - DNA, 1171 bp, Homo sapiens; identical to SEQ ID NO: 534

SEQ ID NO: 1586 - DNA, 227 bp, Homo sapiens; identical to SEQ ID NO: 535

SEQ ID NO: 1587 - DNA, 279 bp, Homo sapiens; identical to SEQ ID NO: 536

SEQ ID NO: 1588 - DNA, 344 bp, Homo sapiens; identical to SEQ ID NO: 537

SEQ ID NO: 1589 - DNA, 198 bp, Homo sapiens; identical to SEQ ID NO: 538

SEQ ID NO: 1590 - DNA, 52 bp, Homo sapiens; identical to SEQ ID NO: 539

SEQ ID NO: 1591 - DNA, 33 bp, Homo sapiens; identical to SEQ ID NO: 540

SEQ ID NO: 1592 - DNA, 271 bp, Homo sapiens; identical to SEQ ID NO: 541

SEQ ID NO: 1593 - DNA, 734 bp, Homo sapiens; identical to SEQ ID NO: 542

SEQ ID NO: 1594 - DNA, 172 bp, Homo sapiens; identical to SEQ ID NO: 543

SEQ ID NO: 1595 - DNA, 250 bp, Homo sapiens; identical to SEQ ID NO: 544

SEQ ID NO: 1596 - DNA, 1278 bp, Homo sapiens; identical to SEQ ID NO: 545

SEQ ID NO: 1597 - DNA, 851 bp, Homo sapiens; identical to SEQ ID NO: 546

SEQ ID NO: 1598 - DNA, 208 bp, Homo sapiens; identical to SEQ ID NO: 547

SEQ ID NO: 1599 - DNA, 37 bp, Homo sapiens; identical to SEQ ID NO: 548

SEQ ID NO: 1600 - DNA, 401 bp, Homo sapiens; identical to SEQ ID NO: 549

SEQ ID NO: 1601 - DNA, 282 bp, Homo sapiens; identical to SEQ ID NO: 550

SEQ ID NO: 1602 - DNA, 258 bp, Homo sapiens; identical to SEQ ID NO: 551

SEQ ID NO: 1603 - DNA, 286 bp, Homo sapiens; identical to SEQ ID NO: 552

SEQ ID NO: 1604 - DNA, 147 bp, Homo sapiens; identical to SEQ ID NO: 553

SEQ ID NO: 1605 - DNA, 399 bp, Homo sapiens; identical to SEQ ID NO: 554

SEQ ID NO: 1606 - DNA, 40 bp, Homo sapiens; identical to SEQ ID NO: 555

SEQ ID NO: 1607 - DNA, 21 bp, Homo sapiens
ccctaaaattattctcatgtg

SEQ ID NO: 1608 - DNA, 302 bp, Homo sapiens; identical to SEQ ID NO: 557

SEQ ID NO: 1609 - DNA, 55 bp, Homo sapiens; identical to SEQ ID NO: 558

SEQ ID NO: 1610 - DNA, 66 bp, Homo sapiens
ccagcaggccccaaatgacaagatacaaaatgtgatacaggacaaagtaaaattcagaccaaaaga

SEQ ID NO: 1611 - DNA, 99 bp, Homo sapiens
acccccaaaaaaatggcaaacaagagagcgaaacaagtggtttgtgtccagagcaaaatagtggaatgttttttctactttaatattgaaataaagaag

SEQ ID NO: 1612 - DNA, 228 bp, Homo sapiens
gagttttgaaaaatagtatatagtattcaacatactcaatactggagacaaatttgttagaataaagtcactcaaataaatcttatgatacatcagccaactttggcagtttacggatacaatcaaacaatgccaaaatgttttttatcaataattcttttaattctcccatcagtagcatatactccaattcaactgaaatacattaaaagagaatcaagtattgta

SEQ ID NO: 1613 - DNA, 605 bp, Homo sapiens
gtatacagttgtagttagtttcatggtgccatatttcttgcagtgtgtcacatcttctgcttaattgtagagttttaatagaaaaatccttcatacatgtgggcacaaattttatattaacataaaaacattttcattcctatcaaacagttctgccaatcccaggcagtaacactcgatctgtaattttgattgaagggctggattcaactttgattacatgcaaataggagaaaaagtaacttgcactgatttgcaattttcattctgccctaaagcttgggtcacttggatccaaatgccaactttcctaaatctctgctcaaaaaagagaggtggaaaactttccagtataattcatgggggtgcttaggtgtagcttttctcacttgaaaaccagagaaccagagaaggtacagaaacctggaaaaatgattataagtcttttctagaacattagaaaccaattaggtcagttgttaaaaatcaaaactagaattttatgtgacatatagaaagaaaatttcctgactttaacacaggaagttgtgaagttgtaaatacaattttcaagatgattcgtttattgcagaaattgatttgag

SEQ ID NO: 1614 - DNA, 32 bp, Homo sapiens
agtatatgcattgaatttgatactcagactct

SEQ ID NO: 1615 - DNA, 13 bp, Homo sapiens
actcctttgaaac

SEQ ID NO: 1616 - DNA, 186 bp, Homo sapiens
ttttcagtcattattttggtggtagaaagaaactttcactctatttctgtaagttatttctatggataaataaaatactcataataccaaattcttaaagattttttaaaaacttttagtaaacttgacaagaaaataccaataattctcttcttttacccacactttggtcaaagaaaacaccaa

SEQ ID NO: 1617 - DNA, 3336 bp, Homo sapiens
ccacactttggtcaagaatagaataaaagtgtgagtctaatcattcttaaccaagttgaaaagaactaaaaataaatttgatgcaagtagcagcttctctgttgctgcatcttcaccacagactcttattacatgaaaattcaaggagcagaacttgatctcaaaatgccattaccataaataaaagataatacatcaatcacagcaacaccatcttataacatggcttaatatttaagtagtccttttactctccttacactgttagacatggggctttgtgccttacaagtccatcatcaagagagtatgatattgaagatgtgagggcttatttctgtttggttcattgacttttaaagcctctcttttgaaataagagtttaattataaaatggtttattgactttatctctcttattatacaaatgctatttacactaaaaactaaatatttctggtagttagcctctgatgagtttaagattatttataaatcatttgttcaagcaatgcattttaagtaaaaatacactcaacttctaactctaaatgtattaagtttcacataagccttgctctttaataatgcaacttacccacaataataatctttaggaaattacctagacattctccaaatcgtgcatgtaaacatttaaaaaacaaatagttaaatgaaatatatgatgatgatagtggtggtggtggtgatgatgatattaatagctaaatgagagaaccctacctgataaatgtgatagatgtgacctcactctaatttcctgaatggaagagttcattttgtctggagaaaacaacaattcttccctatggccttatcattcttacaccattctctgcatcagggcttaacctggaagaatattttcacctactacttcatgaagactaatataaaaccaacatacttcccatgatttaccagctattttttccctttattccatttttaaaattatggtaaaagttacctcaaacaacagtgctgggttttttttctttcatatggacatatccatttcctctattaaaataatacatgatcttcatttcatattttagtaacatcatttgcaagcaaaattctcttaactgcttcattacattcccagctactgtgattacatctgggttattttattacagtagtcaaagtagcactacacatccacaaacatatccaagcattacactgatatatattatgctttaacaaacttacttaattatacttaacattttataattttttccctactgtatttataattttttgttcaaaaaattacattacacttttttctgtgattttatatatatttattcatattgccttgtatatcatatgtgcatttatttatattccattataaatgtttatctttttctccaagtctcacatactctattgttattagcaggcattattatagtagagacatttccttgaatcagacattatgtccggcaactttgagaaaatatggttagtgaatattttaaggaaaatttcagaattatttaacaacacttaaaaggactccaaaaaagaaattgttaaatataaaattaacttatgaggtcttctattaagttatttctttcatagatgcagaaagttaaattttgtctatgaagttaaaggttttgcttttttcagagagaatttaagatgccacagtagtctcaaggagctctgtcttagcttgttgtttcccaaaattataataaatgagtggcctgagggaaaggcaagtaaaatcatcataataaacgtcatgacctgataattctctacctcaaggaagatccaatctcctattaaagtggaaataaagttaataaaaaaaaggaggaggaaggctatcaccattttcatggcccttttatgggcctctgtgctggagtcccttgagcccagagagttgagctgcaaattcttggtgtgtctcactaaggatataaataaaaggagcaaagaggtcagagtcagaagaaagggaataacgtatgtcaagctgagaagcctaaggccttgaagacagactattttacttgtatctgagtgcaaagtcatgtttttttcacaactcactaatggcattggacataaaaaggtaaacaaacgataagaacaaagaccgcaggaaaagcacaagaaccactctgttcattctccacttcagccaggcaaaaaataagcgggagaaattggctatcttaagcaagtagaaaatgcttaggcaggtggcaaactagatacttaactgattaattaatgcccaaagaatagtaaacagttttactagtttacggatggtatatagatgaggggacaataccattataaatgaatcaaatagtattaaatacagtcgaatgattctgactatagccaagctggtgaggatgaaatcagctgatgagaccttccaactcttggcccactcaatgcagtttaccagtccaatgagcccgtttcccagcattcctaagacaagtcctcttgttgccaccaccagaaagaaaatattaattccaacgaacatttctatgaaaatatttccgatattctacttcactgacagctttatagtcaaacagttgcagatgggcatgcatttatgatgctttctatctatgttttcatcacaatttcagaaggcatagccaaattcagatatatgttcagagatcttcatgaaaaaaatagtttgttctatttatattgtaactccggtactaaaccaaattgttaagagatacaaagcttcatgaatacctttcttaccactttcagtcagctactatataatttctagaacaaacactaatgatgtctatttatcttcagcatcagccacaattttccattcatggtaatgactaaagaagcgaagtcgagtatgtaaacatgcaaaaatgagagatcatttttcactaatttgcattttcatctcccctgagccataccacttgaatacaaatatcttaaattttgaatagaaattgttagaaataacatttatttcagtaattatttgtctctcattcagtaacatccttctacataccaagcatttttgttgatgcaatatgatttatagaaataagtccctaaaattattcataattcaagaatttcacccaagtcctaaaactattaatataaataatttgtatgcaatgttacaggagctaaaaagaataaacaaaatataccagaattaaagacgaggaagatacaaatgcttcagtgaagaattgactatagttctctgaggttagggacattcagtttgaactggaatt

SEQ ID NO: 1618 - DNA, 199 bp, Homo sapiens
ctggaattctttagaatttatgaaaaagaagaaaagaactaatattcaagacaggtttaagggcactttcaaactacaaaagtgacataaacaagctataccatgcatctataggcaggaacttttttgtttcacatttgtatggctattttaagcaaaatgcactctccaacttccatgtcctaaatttcatgttcta

SEQ ID NO: 1619 - DNA, 41 bp, Homo sapiens
gaaattggaactgaaagtgggagaatttgtttagaggattt

SEQ ID NO: 1620 - DNA, 29 bp, Homo sapiens
tatggtgatttaaaaataggcatgaagtc

SEQ ID NO: 1621 - DNA, 207 bp, Homo sapiens
cagtgtctgagttcttgccactggagcttgagaagtgatgtgtgaaaactctatgtccccaacaaatacagcctcaccccaaacacacacataaatacacatgcacacttgtaatgaagaataccccctgggcaaccatggaaaaatgtgttaatatttgcgaagacttctttagcctgagtcaatcaataattgcagagagaaggg

SEQ ID NO: 1622 - DNA, 41 bp, Homo sapiens
tggtattgtcaaaagctgactttaaaaaatggttacgtata

SEQ ID NO: 1623 - DNA, 190 bp, Homo sapiens
tccatatcttaaatttttaaaagcaattaaaaaaggaaaaaaaattggttacctataggaaaggaaacacagagcatatgacaggaaagaagctaggcttctctgaatacattttgttttgaagttttacccctggtaccatgaacatttattaaataatcactaaaaattaaaataaaggaatattaat

SEQ ID NO: 1624 - DNA, 547 bp, Homo sapiens
tgaacctgtctgatggatgatttaactaaaagaggaattgtttcaaatgatcctacaacatagtttttttatctccagaaggatatatgctaagataaatctgaaagtgttttaataattaagctgttagaataatctaatctgagtactgttagtttgaaactattatatgcgctgatgcacacaattaattatgtgaatgttgtgtggttacggaccaagattttcagcatgagaaaaaaagaagtaagaatataaaatctgaattggaaatatcaacatgaacttatttttaaaatctattctggtagtttaagcacaaaagacatttattaaagtgtatcagagaatcattacaaagtctgcagaagcagattcaaagctaagcatctagatacaatgtgtgtatcagattttttactctaccatataccatccccaagtttctaaaatctcacatttgccacagggacataaaaaagaagctggaataacatttcccagaccccatggtcaattaaattcccccttaaaaaaagacactttg

SEQ ID NO: 1625 - DNA, 236 bp, Homo sapiens
gtagcctgcatagaggatgcaagtagctgacacaaatgttattgccttcatgtacaacccctacaattctggattcctgaaagtaaccctccagaattagtctcacttcccccaaagccttctaatgtttgtatagtgtctaactccctgattaaacttcttctaactcagaacatctaaaatgtcttgttttctacctaatgtggtctgaggcttctcaaaaaaaaaaatgcttc

SEQ ID NO: 1626 - DNA, 20 bp, Homo sapiens
ttcctccatctcttctctcc

SEQ ID NO: 1627 - DNA, 161 bp, Homo sapiens
tattttctcttaacaatgcctgggtttttgtatgtgtgtatacatatttacagtaaatcctgagataaatattacccctcaaaaatgggctgccttcttattctgtcagactactaagtgtgtgaaattgtatcaatccaatctgtagtttatctgtattt

SEQ ID NO: 1628 - DNA, 647 bp, Homo sapiens
acaacaagaaaaactgcctaaaatcagtgaaggatcctggctgaaagccggttttctccccctcctccagtagcaacagatggctttcacccagtgtcagcatgggagtccaagtcaggcaatcttcctgcccctccttgagtgtcagtcaatcaatgtcttgtatcagtggagggtcttgatatcatcaggttaactgcccccttcctgcagcaaatgggtttttcctggtgttcatgcagagtccaggattggtgggttttctgccttccttcactggcagatcctttctgtttagccagcatgcagcccagagcaagtgagtttcctggacttcccctgtgacaacagacttctaatatgtattaatacagacctaggagtgcaggcaggtttcttaccccactccttgtgccaatcagctattgcccaatatcagagtagggtccaggttacagtgtattccctgcccctcactcagcagcaggcagattttgcataataaagatccagaacatgtgtagttttcttgcctgtcccctagcactggccaacaaccaccttttactcatgcagggtccagtgtaaatgggcttctccagtttctattactccactttaaaacttaagaagattttgttcccatt

SEQ ID NO: 1629 - DNA, 331 bp, Homo sapiens
ctcaagctggttttcaaaatgcatgcataaatgcatgctatatcatattcttccacatgcatggtttaaaaaatgtctcaattaaaaaatagattcatgtataggtgattttttatgcacctatgaaatctggccttgtaatgaagaatacaatagatcttaataatctgacaattattaaatgtgtttcattgtctaaaagagaggtttgaggggagaaaaagaaaagtctttcttgaaatatggaaataagagtatatatttagctctgagtatgttctggtaagaattacaatgatgtcaaactatatgtacatattaaagccatggc

SEQ ID NO: 1630 - DNA, 1819 bp, Homo sapiens
aattaaagagtttttatgtgggcttctacttgattttattttttcctaatacaaaaaagttttcgtcaaggctttcaaggagccaaggtttcccatcatatcaagaatctaatcttccacagcattatcagtgaggtctgactcagcttgctcttcccaagaatcagaatcagagtgatcagaaaggcagaaggctcctactatctggaaaagcatcatgcccagcaggctgtttaccataaagtgaatcaaatctgctataaaagctgaaaaacagtacatgataaaaagaaaataagaaagattacgactccaaaatcatttatttcccaatggaatgttaataaaccaaggactccatcagaatcataatattcacataattaattctacactttatccaaaggaaaaatggctgagaaaaattagctattgtgaaccacccccacctccaaaaattatcaggcagatagcaaaccaaagggttgagtactgatcagtgtccaaaaggaaacgtactttttttctagtttggcattagcacaagttaatggtgtggtgtgaacataagtataaaaatattaagcagtattaaacacagctgttaaattctggagctggctaacctgatgaaaagtcagttaaaggaagcttccaatgcccaagccagtcaatgcagttaatctgtacaatcaagccatttccaatcatgaattttctaatttgtacaatcaagccatttccaatcatgaatactctaatcatgaattctcctaatatcaccctcagcaaaagaagtgtggattaggcattcaaatctaaacatcaaggggcagataaaaactacaaccacctaaattattgctcctatcccactctcaggtggaaagaaggaaatctttcttcagctctagagcattaaggagtaggatttggagctttgtgactgttctttgcctattcccgtcccattggaataggccctcaatctggccatgttatcagtgggtggctgctattttccccacggtctcagggtggaagataaggttttcatggagttacccagaaacggagcaagtagggcgtaaagggtggcacaaaagaggaatagaagacagaatgagtccacatagctttacatatttggaaatgaaaaatccaggacgtaatgactcctgtgactctgaatggctctgtgtattagtctttcagttttcaaagggagtaaattatatgtgtgaactgaaactatatatcttctcccagttctcagaattgatcatttattttacatcgctcttcagtctctataccagtattttagaagttgtcataagtaattcctctaagtgctacctcgctggagtggtactggagcagcaaagtagcaaaagaatactagctgggaacacaaaattaatttttacaaatttatcagtggcacgttatttctaccagtcatataatcagtagactatatagaaacagaggtactctagggtaccgtacttgtgctctgaatagctgctagacatgcagtgcacggtgcgatgtgtggtatctcaacaatgcttttcagaacaagactgtaaccttaaggtcatgatcagaaatcacacatttgaataatccatgaatgaagacggtgtgtgcgattaaaaaatacagtgctttctagttaaaatgggagataagtgaaggtaatgaaatgtgcaccatttaaataacaaaagtattgtggctattagagattcactgtgctgttactctaatggtattaagagtttggaagtacaggccgggcgctgtggctcac

SEQ ID NO: 1631 - DNA, 397 bp, Homo sapiens
gagtttggaagtacagagtagtattccagctcttggagcctagccacaggtttcacagatgcatctccatgcagaaatggctgaagcttccacagctaatctgaactttttaagggtttacatggctgggaatataattttgtatgtatgtccttatgtatatacgcgtgtgtgtccactagttttttgcttgaatgtttatcattcctgtcacttgcaatttaaatattcctaataaatagaaaaatccaaagactaagattgtgatcctttttatgtctatggtatattatgaatacagagaccttgtgcttttattggcgtaggaatcatcttgccctaatattaatattatgaaatcaaaagggtaagattcctaacatcccacataacacag

SEQ ID NO: 1632 - DNA, 1555 bp, Homo sapiens
aactatctgcatggatgttcgtacatgctatataacacatcctattccagagccacctaccatcagttgagctctaaatggtaaatgccacagtgagaagcagacaggaaggggcggagcgccagcggcgcccggggctacgcgccgcactgcaccgagcggcggcagcggcaagcttgggtgtgagcccgggagccgctttgcttaccgtcctgccggtcccagccgtcgctaggaggtccgcgggccctgcggcaaccctcgctacagacgctgggcgggcggcgacacctggctcatggcccccgcggcggctccgtcctccttggccgtcagggcctcaagccccgccgcgacacccacctcgtacggcgtcttctgcaaggggctctcccgcaccctgctcgccttcttcgagctggcctggcagctgcgcatgaacttcccgtacttctacgtcgcgggctcggtgatcctcaacatccgattgcaggtacatatttagagccatgactaagctaacggcctccggggccagcatgatggccgactcccagggtccgttgcggcgcggcggagcagccaatggcgagccccacagtctcgcgagagtgctcaggcgctcttcgtggctgccctcttagctgctagcggagctcctcagggggcggccgggagcctacaatccctagaaagagaatacgctgttccggaaacagaactgcagttaagaccctcgaaaacatctaagaaagtgtgcatcctaaaacacctgacgaatttcagaatgtgacaaagcgcagaggatgcattatttcaaaacaaaacagaaggctaaaatttgcaggaaaaagaaaatcagtaaaccgggaatcctcggactggattgtaagcaagatttcaatgaataagaagctgaaggtattaaggctgtgatatagaaggtacatatttcatcccacaagagaaaacaataataatcagaaattttcggtgaaaaaaacgcaaaactgtacaggaaaatcatcctccaagtaccagacataaaatgctgcaagcttttgaactaatggcgagagtgtaagaaaatgggctctacttcagtgatcctgtggcaggacgtggatcaagacttggaaccgcagaaaacgaaatcccatagtagcacaaagcttggctgttcagtgaataacatttaaataatcgtaaaatacaaatgttgtttatggtttttattgtttaagggcatacttaattatggttacaaagtggagtgcaaatgttatttaccatgttttaaaaatacagccggaaaatacaagtgggaatgttgaaggagggcgggggaagtaaatggaatgggggttatgtccttataaagtggaaacttgaaaggtactgtctgttgttgagtggggaaagacatttttattacttacagggtagccataaagtttctaaaacggtaatatattaaagagggagagtggtaggggagaacagtatgaagtcaacaggaaatggctaaagatggagagctcaggtagaatagttt

SEQ ID NO: 1633 - DNA, 129 bp, Homo sapiens
atacagcctagagagctttcattttccaaagagtgtggggataaattagtgaatgcatatttttcaaaattaagaaaacagaacatataattttgaacgctgagaaaaataaaaatttaaaaactacac

SEQ ID NO: 1634 - DNA, 801 bp, Homo sapiens
ttcttcggattaaaaaaactaataataaatcaccaagagtggtaaagttttaaatcaagatctgatatagaaaagtgcagaaaaagtagtatacgcattttttttttcaggaaaaaattaactaataaaccactaagaggggtaaagtgttaaaatagttgcattgttctatattccactcattgtgtccagcaaacagtgttctatggctttaagtagtaagcatcttgccccgtccaacaccatgtctggcctagggtaattgttctttctagtctttattctttgtctccagccaaactccatttgggcacattctcctatagccttttctacctgaagatactctgtgttttaaagctaagcttaggtggcgctttttccattaaatttttcctggattccactgaccatataggagctcacttcttttaatccataaggccattttcataggttgccttatttttccctaatcgtgcatcaactgtctgttttatatacccaagacaggtttcctagactgcgataagccaaaacattttagtctaaaatatcagaagtgtagtttaatcaatgaaatagtaataccaagggatttagaatcgtggacatcactgtttcccagagcactgatgtcccaatttgtaacacaaaagactgtctagtcttaatcctgaaatggtgacagagtaggatgctccatttgggtgactatgtgaacatattcctataacttttttcctcacatcagtcatttgttaaaccgaagatgaagaaacagactttgtatttattaca

SEQ ID NO: 1635 - DNA, 26 bp, Homo sapiens
ggtagtaacagtatgtgtgtgtactg

SEQ ID NO: 1636 - DNA, 274 bp, Homo sapiens
gttactacttacaatatatgcataaagttacagcttacatttacctcgtaatatatgtatatatatatattaggagttaaatgtattaggaggtaaatgtaaactctgtggtttatcatttattcacaattgctcttaattcttggggtatagtttgcctcctacatgatgcaattcagtgaaattcccaggagacaaaacaagattttgacctgaataaaccacttattgttgtaattcacaagtgagtttattcttcctggcacacttccag

SEQ ID NO: 1637 - DNA, 399 bp, Homo sapiens
gaatggcaattttgttggtatgctctacatagtcagcagtcaataaaggaaacatatattcgttcctgataataagatgattcactttattgcccataaattgggctttttcaggccatcatgcacgttgattgatccagagatccctcaagcatgaaaaagcagagacataggtggtatagttattatcaatagagataagaaatgtagctggcaaaaaaaaaaatgggaaacgatgcgttacagcttattttaactataaaaggaaaacagtgaacatagcaacatatgtaacctaagggataggggaaaagttgtttttttttttttaattctgggtaaaaatacatgtgattacttgacaaatagcatatcattaccatcagcatcatttttaaa

SEQ ID NO: 1638 - DNA, 787 bp, Homo sapiens
tgataaccaaccagacctcaaatgaatctccagtaattcctaaagttatatttcataaggagttcaattttcttaaatgtgtagataattacaaataattctgtttctcaaatttctggacagaaatattacctgggtaatagttattttttttaacataactattgagggtctttcatactaaaatataaatatttaacatgatttgatatgtaagttcaagtattttatactctctgcagccttaaacctattggcttattttattagagggttggtgggattgagggatatgggagcaaagggagagagaggaaagaacgttgtcctcagaatggaagggaaacactttcctgtgctacccagagtagagatcagacaatgttaaattttgaagccatgtctgttcctgtcctgaggatccctaactaaattttgttagaaaatcttgcagtttgcttttaatgggagatctttctggcaggacatcaatagcttttgatagcgtcaagaagaaaataaagttacatgcagaagcataaaggggtaggatgaaagttgaggaatatagggacaaaagatgagggaaaggaatatcctaatacttggaagtttgagcatggaaagtagtctaaagacgacttgggaagttccaagaaaatgaaccaagaaaagaacctctgcaagaactatgagaattcccaacaattgggttggattgattcatattagtctattacttgggttaccttgagtgtggggattcttcttgcagttttaacacttg

SEQ ID NO: 1639 - DNA, 508 bp, Homo sapiens
gacttaataggatttgctcagcaggattaccaccaggtcaagtcatgagatcttttcaaaatataagtaaacctccccttacccctactctccacaaatacaaatttcagcagtgctcttgggacaactaaaaggcccaaggaccttcccaaaagcctactacaaatgaagaaactatggaagtcttagtagcttaattgcaggacatccctgccagtttctatcctgattagggatctgcaatgaacattacaaaatcttcaccatctccatggctttcaacaccaagcatatggacttagccactgtaaaatagtggcatgcatcaatgaacaataaagagaaatggagatcattcatattattagtgagggaagttgggtacaacttttcatcagccaaaaagagggagaaaaaaatcacaccaccaaataatgaaatactgtaactaagatcattggcagagaattagagattatgttcagcagattaaaaaaaaaaagaaaac

SEQ ID NO: 1640 - DNA, 1379 bp, Homo sapiens
gccaaaaatacgagatgcttaaaaaaagaactgttgttcaagagatcattttcactttttaattggtttttgaaaactgtgaaagtatctcaaactgaagtctaaaaggaaaataatagaagcttcaaagttcaggggccaggttatatctatataaaagggaagctaacttatttccagaactgattcatttattaaacatggggctaaggaatagaggtggcaatatacaagtcaggataatgcctttgtcttctgaagctgcatctacattggtgcccctcaaaatagctaaaattgaaaatagtttatctgtcacctgggatttcttctacaaataaccttcccaaaaaaatattgcctaacatttttctgaatttatcaagccaaccatctgatcagttttctaaatgaagatttattcttggcaataatctagctcagggcctaggtcttgtacacagcattaagcaatgtaacagatgagtgcactggaagtatggatttgcagatggcctccttgtttctgtattttaattaaggaagtctctagctcaaaggacatgagattaagggcagcagcaaaccatgtgaactatcagagattcaacagagacaatcacgccctctgaaatatgtattgatccatgcatattttcactaggatgttttctttgagtaaagctaaggacaacatggcttgcgcacccaaaatatcttctcatcttaagttctaggcctaaggcagggctcaggcatcagccgtttttggcattagaaacaggttattcaggttattggcaactcttctataaatcaactgtgtgaccaaactgggttggggggagggcaggggcgggaaactcaaaaactctcatgacatcaagactataaacttactttaggggaaagcaattggcaaaaaaaaaaaaaaaaaaatgtcgatcattttcttttcccaattatttgttcccaggataggatacagttctctccagattgcctgaaactaggtttggatgtaagagtcgtggttttcttggatcgtggcttgcatctccaacccaagctttcattatggaaaatgatggtgcagagcttaatctcaaaatgccattgtaatagggagactgcaatacagtggtagcaacagtcccacactttctcccagccttcatcatttaatagtcattttctgtgcttttattatctggaataggtctctgctccatatggcttcatctctgcaaggatagtacgtgagatgtgaagacttaatcctaatgagacatttacttctaagtcccactcactagaagcaagggttgtgtatggttgtttaaatcttttgaatcttgatcattaaagaaaagtttagt

SEQ ID NO: 1641 - DNA, 1294 bp, Homo sapiens
tttaacttatttactgaaaggagtaattccaaaccatattatcctcactatctgaacctaaatatagccagtgtgattttaatgttgccctttctaaagcaagataatgcccatgataatcattaggaaatttattatacagtatctaacaatgaatggagttttaaaaatctaaatgtctgtataggcctggactggccttaagattatatattatatacattttcagttactttatttttttgtaaaagtcaacctagaactatacacaaatacaaacatgcctaaaatttatgcaaatatgtgacattctcttataaattttcctttatgttcttattcttagtgagttagttggttgtgttagttttctctggtgtgacacactagtattcatggtatgacaaaaatatgtcattacacatgtgcacacacacagagatcctgtgtcaaagtgtggttttgattcaaaaaagtaaaaatataagcatcattatggacatagggataagtattcaacttctttttagaaattcaattgattttgcacttatcctacaaaggtaggatagcttgaattcctagctggagtcctaatgagagaatgctattttgttttaaaagttacctctattgctatgagattatatgctttcaatatttttagttcttaatgtatttgacttagtgttataaaaatatgccacctactccggattggagtaggtattaggttctaatggcatttagaaccatttccaaatattactgtttttttcctcacatgtgaatgtaatcacacatttgccagcacatataaaataaatacatgttgcattatatattttacatttatattaagtctcaaatatttcctagttactagcaaatattaaaatgacaatgatacttacttttttaaaaaaatccggtattacattggctgactttatgagtaaatcgttcatttataggccattctagggaaattttgtgatgcttaattacaccttaaaataatctgggtgaaaaacacatgctaaaatacatcttcaatgtgttctcattaattcccctggaatacagaaaaatccagaaaagtctacaaaactaaagtttcactctttttaggtggcacttaagatgccacagtggtcccacagcagtctgtctcagcatgcagttttccaaaattaggacaaatgagtggcttgaaggaaaaataattgacgttaacaagacaaaaaaattggcctgctatttctgctgtataaggaaaatccaacctgttggt

SEQ ID NO: 1642 - DNA, 1841 bp, Homo sapiens
caccatcattttcattttcattttcatggccctcttatgggccttcattctgaggtccctcgggcccatggtgttgagctgcaaattcctgatatgtctcatcaaggacagaattaaaaggagcagtgagatcagggacagaagaaaggaaattaagtagatcaaactgacaagaatccagaggctacaatatagaattttacttacatctaaagaccaagttgagtttctttcatacattgtgtagatgttaatccacaagtcactaagtccacctgttaatgcaaggttgaaaaacagtaagagcaaggaccccagtgggagttcaagtagcgttctgctaattctccatctcagccagatgaagcatgggtgggaaaaataggctattttaaagaagtagaaaacactaaggcagcaagccaggtaactaagtgattggtcagtgcccaaaaaatatgaataaattttattagtttattgaaggcatatagatgtggccataatgctgttacaaatgaatcaagtagtattatccaaagttgactgattgtggagatagccaggctggtgaggatgcagttgtctaataagatcatttgactcctcaccagtcaatgcagttaactagtacaatgaacccattccctaacattcagattatgaattctcccatcattactatcagaaaggtatttccaattccaggtggcatttctggagaaacaaatccagaaagctaatactatgtttcactgatacttttgctgtcaaaacgttgcagaataatatccaacttgatgattttcagatttatatttaaaatgttcagagtaactcagaatgatcttctgtttgatgccacctcacttatcttcacaaaagatctttctgttttttttatattcatctcactagtaggcctgaaatatgtgcaagaagatccagtctcacatatcttaatttaaaaaaaactttaacattatttttaatcagctactgacttacaaattaaatagtaaatgtagtaaatgtgcccactcatcattggcactgagagcaatttcccacttgtgaggacatctagaagggcgaagtcaggtatgcaaatatcaaacagatttctttacactgatttgtaattttctcctcaactgaaagtcaataccatttggatttgaatatcttaattttacaagaattatctaaaaataacctctacaatatatgtattactcattagtttcattaaataaactccataatatttccaattctactttagatgaattaagtgtaataaaaagaagcatcaaaaagctcacagagtagtgaaaagaagcaacattaaatgtgcttttactactgaatgtaaccacagtttgatcaaaatgcaattacaacacagaggagggtgttataaaatctatggccaataactaattctagtttcatgaagataatgacagttggcttgggtcttgaagcttttaggatttcttaaagaaatagacaaaaagggagatgattttacataattatgtaaaagcatatgtaaagaaacaaaaagtattcctttatctgagctattttactgaacttttgagcttggtttccaatgccttcctggctatttgattttgaataagctcttatcaactgaaatgaaaaaaaaatagtaaaaaaggatggaaaaatagcaaaaaaacataagagggagaataggagggagattctccttttcattaattcttcctttggtaaaattctttgtctcataaaaatgtatccacagtaaaatacattttataatttatttgtattattttgtaactctaata

SEQ ID NO: 1643 - DNA, 212 bp, Homo sapiens
attgctggcactcactgagaggctcttgatgtatgtcttacagtgactcccaaacccaggcaaaaatctttctacccaaaagctgcaaatctatgattctgcaaggacaggacaggattttgcctgccttgttctctaacaatgtgtttctcattcagccaattttgacgctgactggcaaactggccaccaactctcttaacaaccacata

SEQ ID NO: 1644 - DNA, 696 bp, Homo sapiens
tagtgctaacttagttggcagtcccactagcagcacacaaaaggagaaaatgaattaggcttgactgtgaaacaagtatcagagcaagaaaagaaagtacctccttacagaaaatgttacattcatgtatgagcttatgaaagatttctgttctaatcctgaaaaacccaacactgctctgtaatctttctagttcaatcaagaaatcatacagaatcaaaaggaacatggtctgccacctaagatgggggaggcttggtacttttcttcatgaaaaggaactacttctgttgaagatggctagaaaactagatttcatgacccaagaagcaagatagccctagagatcactaatgttttcagaaatgctctgcaagtcatgtaaaggctaattgagaagaagattccattgataggcatggtttagctgtgaaaaacaccgaaaacaagtcagtcaggagatagtgattaaagaacatctaagtttgtagttacgctgaagaaactaaaaataaaagatgcaataacaagtataaaaaccacaagtcccatatactatgagttgtattcaaagtccaagttaataatcacaattttttaaatctacataattaatctatgtcctactctagacaaaatatcatccagtgtctagaatgaaagcaaaatgactgtgcaaatatacaaacaccccct

SEQ ID NO: 1645 - DNA, 334 bp, Homo sapiens
aaaaacaccccttaaagcatgatctggctcagagaagatgctgtctaatgaagattttgctagaaaaagccacctactaagacatagcagataaaccacccaagacagtgaggaaattggtgctcctttttcttggaaatcagtattggtatgggtttctacctgatgttacattcagtacagtttaagaaaacatgccttgatatacttgatttgtgtcttatttgccttcagaactagagctatgggttggagataagccaatttcagcagtagaaacaggttatttgttcctgtcctataaattacctgactgtatgcattgaaataacca

SEQ ID NO: 1646 - DNA, 71 bp, Homo sapiens
gtggatgaatgaaatgattctgagagtactccaattatgaaagtgtagaactgacatggtttggctgtgtc

SEQ ID NO: 1647 - DNA, 123 bp, Homo sapiens
gccccaggtagcagaccactggattcagttaagactcataaggaccaacaaaaggtggatccaggaaggagaaggtgcatgcttgaccctcttatcttcctcatcacaatactaaaaacacca

SEQ ID NO: 1648 - DNA, 1432 bp, Homo sapiens
ttagtaagcacaatcaggtgaaggcatttgagacttttatggcgtgactctaacaaccttgatagtaagtaattgggagccttaaaaattataaacccccctgaaaactcaggcattacagcaaccatctccattagtggcaattaattatactttgaattttctcaccttgaagtcaggtttaaaaataccctttacctgtgtgtgtgtgacaaggcatggtatgaagtagggatgagatcagcagaggtgaagtcaaggacagagtagggacaaggaaatgaacccagggagaaggtttcacttgaatagggaatgacagtagtattgtttagagggatccctaaatgtatcagtggatgttccgagagcactgggtattttgcagtacatgaaacctctacagcctcatatttcactacacaattcgggagaaagtaaaatatgagaaaaaagattagtggatttagggagataaggcagtgaattaacagctcactgtttggagagtatcatatataacagctcaggacacaaattctttgataaatgatatcttcagggaattttcagacaaaataaaagttttccaattagtttccttgagataatgtcacttttccccataaacacactgtagttgatttcatttttcatatgttggtttgctgatgatttagacaaaggtgaatgaacctggctttactcgcaggatacatattttaaaatggtatgctggttcttagacaggtaacttccaccagccagccctcaaggtgaataagaaacacctttttggctctttggaacactaactctttcaggacattacatttcatctccagtacactaattggcaatttgggagcctgaagctgtaatctatctcctagaagagttgttacctcacacctagggggtagtttactttcccggtgatatcacagaatagcagaatttgaaggaattttgagcagtgaaatatacaggtcttggccagaggaacgcaggaaagacaggcatattacacgcagtttcaaccccagtagcagcccctgcatagtcttgggatcatcttaaactcccttgcttccgttttctaaccaggaaacaaattccagatcaattctagatggaagctgacaagtctttataaaacactgtcttattagatgagtggactttgtgatgtcttctgttatgtcaacagagagatggtacgatcctgaccttttttcgggaagcacttccactttcagaaggttttgttcaacccatctctaagatgcaccaatctatctgatttcaatatttcttgccagaatagctatatatttaccttatgtaacaggttccaccctcaggtattcttcctaaattactaatgctatgtcttaaatttattatgtcttttttacttaggaagcactgg

SEQ ID NO: 1649 - DNA, 465 bp, Homo sapiens
tctagttttttttactagatagttattatcattattactgttgtacagatatagtcagggttgaagtttacttcatgataaaactgtctgtaaaaaattagtaacatacattaattctaggggaagagttttaaattttcataaactttggaaggctgcataaaatagtcaacatttttattataaatttgctaatgtaaccatacaagtataatttaaaaacttgtttttaaacaagtaagtattatacttaaaatggcagaaagcaaactggatttctttgaaagcatctgttgtttttgactcctcactgatttaaactaactttatctcagtaccaatgaatgatctttcccatagtttcttatttacccatctttctttcatgttaaccaccctaaattgcaggatttttaaatggcggggagtgggtaaggatattgacctgcttattacacgacaaaa

SEQ ID NO: 1650 - DNA, 243 bp, Homo sapiens
catagtattgaaaagaaaatagctgggttcaattggcttgacaaaaagctattaagagctattttaatgtaaagcaagttacccttctgaagtccaaattgctccttgtggggaagatgaagcaaggaccctgaagctctgcccaaagttgcagggctggcttcagcagagtctgggcatatcctggctctgctacagcacagctaatgaccattttctttatgagatgctctatggaaattg

SEQ ID NO: 1651 - DNA, 336 bp, Homo sapiens
actgatgccccttaggaggcatatgctagagagagctgatgggctagctgaggttggagatgattattgtgatctcagttcatgcagttgtctccagcagagcccgattgatcatatacagacacacacaatgagttcagctatggacctggctaattgagggattacttttcagaagggccagtcacaaagacagaggacatgagcagagaagcgtgactggggaaaagacatgttttggacttcatgaattttgactatctctgagagagctgagtgagggtatgtgattggacgtccgatgcacaggtatggctttcaagagagagagaaaca

SEQ ID NO: 1652 - DNA, 201 bp, Homo sapiens
aatatagatgatttttgtttactgatacatttaatcaacaaatttggatattgaagcttagagggaacgatgggaactttggcagttgatgtaattgtataggaagaatgttttagattaagaagagaatggaaccacactaggcccaccagacagacacattggaatcactgtcatttaaagaataagcaaaggacagaa

SEQ ID NO: 1653 - DNA, 1213 bp, Homo sapiens
aataataataataacaacaacaacaaccataggcaaagagagagaaagaggacaactttttaatagatgactttgttctcttttgcattattgttattgattactactactttttctcttaataaacagcaaaagttcaggaaggttgtaatgtttttgaaataaagctcatgggtggcagatgtcggcttccaacacaggcctcttggctcatgctcaattcatccttttcctaatacacactgttaaatttctcttctgcacacagccttctattagattcttgttctcatagaacttacagccaagatacagaatactgtaaatatcaggattgaatactaaaatatcagttataaatcttatacgagtgaagagaaggttatcaacaggtattttcatctctgctacagagccaataaaattaataagtgtcttagctgagagtaatgagcctattactttgaaccatcataagaagttagagtaagttagtattttaggaaataaagcaggagctgttgattaatttttaagtttgtcatgatagcataatttctctaagatattaaattttagtattttatataggaaattaagcaaaactgtttgtgaaatacatacataagtattcacttacatatatactcccatatgtttatattacaataatggaaataaagttcaataatcaagccaagaaccaaactattgctggattttatctttctcacttacatcaatattgtcagtgcttagattttgtttttgattgtttccaaaatagttattttccatctacaataaaagagaaatgttcatatttgctgaagaaatgttgaagatgcttatgctggatgaagtttgtgtctacagtgaaaagcatcagatcaaaaccagttgttttggtgttttgagctgtcttaggtgagatgcatgctgatctaattagtggtgcaaaaaatatttttaaaaggaaaaatagctgggctgattgttgtacattgtcatcaattagcaataactagacaattcatttcaaaggaaagaaaaatatatcactaattgactgttactaataaacattgtgccaagcaagctcaactacttagagtgcagactttaatgttgctttgtgtgtctcttactccttgcatagttttccttcaaccactgtgaactttgtcagaacacaataatccccatttttaac

SEQ ID NO: 1654 - DNA, 196 bp, Homo sapiens
acaaacattggaattttacctataaatcgctaaaagtgagatccttttccttttcctccccaggacttcctcctaactgagaataggttggcagatcacctggcttttgcatttggcacctctctcattccaataagagaccagaggtttccttcagctttttcatatgagttgttatctgcttgttgggttattg

SEQ ID NO: 1655 - DNA, 642 bp, Homo sapiens
acattaggaataatactgaattgattgtttgttgatcccacattctttcaatactttttctcctctaagattactattatattttttattacattctagagccttttgaaatactttagcttatgtgctttagaataatcattaagaagcctggatgaataacacaggggagaaaagataggcatgcatgaacagtcatgctggctagggaaaaaatactgtttgagtcctagttacaagggggccaaaatgaattgatcatttgccttttggctttagaagtgggcttatctgagacaaagagaagggcaaactcaaaaaactgggtcctgcaaagtgctggagatgtcagagagcaacaggcccagagataatgccatgaatctgataacaaaagagggggaggaaaggaaggtgcatgtctttttttagtaacatgtgaacactaagaatgagagggttattgtctctttttttaaaagtatgtttgaaatttatcatggcttacaaaataagagcactgaaataatcatttgagaaataatgaagttattatatatgaggggtgctactggggtaatactctgtacattgtttgccatgtttgtttccaacatttatttcctcctttgagaatgggaa

SEQ ID NO: 1656 - DNA, 1001 bp, Homo sapiens
ttcaataccctgaagctatcattggttatattccaacactgtcttaactttccttccttttctatacaattgacaaggagttaatatattgaaccaaatgatattatcattttgaagtatttgcccaaggccatgagcattatattctccatttcaacaatgacttaggagaaggcagctctgaaaatgtagggtcaaagcaggacaaaactcaactcagaacaatgactgaagactagttttatttgattgatgagctggagtattggttaagattatctaacattttttacacccctaacccatggtataaaacatgtttatgtcaatcctaatcacagttcccaactattaggttatttaacaataacactgcagacatttaaatcatgatttattcaaagatgccttttgcacataaagtttattttgttagtttggttagctctgcattgttttaaagataattctcttgcaaaggataattcattgaaaagtattttgctaagactccagaaaaaaaatggatcacaggcaagttcccagaagaagcatattaataaagtgttggaaaacctctgaaggattatattctctagagatgaccatctattggacatattagcctttaaagtcattttatttttaagtttaaagatctatgtgaaatactgttttgaatcctggaattcaaatacaacctttcatattgttaatctttcttgaagtttaaagagatgggaataaagaaaaaattatttcatcttaaatttagctccgtgtatacttttttctttttaactcacctagcttttatgaacactgcctatggactaggaagtatagagaatacaaaacaactgacataatccctaaatataggagtcttttgtatatatgaagtggctgcatatgcataataccctgtttaggaaaatgctgcagggtcagctgtattttaaataatcaatggcttattttaagtcactaatcttaaatcg

SEQ ID NO: 1657 - DNA, 422 bp, Homo sapiens
caagaggccaaagaggaagttttaagctttaaggagattccagatgttctgagaaggaggattgaaatttaaaatggaacacttgctaaaagcaaccagaaaaaatttgaaaattaatagttattttgaagaatggatagaacttggacaaaataaaagggagtgggatgtgtataggtgtatatgaatgtgagtatatgtgtgctgacacatgtatgtagaaacaacctgagaacattaaagtggcagggtggatgtgtggcaaatagagaacataataagcatgcatcactgcaacacccttttgggagttaaaaaagaaataaagctgagtaggttgagtgaaaccaacctcttggaaagccttgatcttctcttttagaagtttatagataaataaatacatttatttatatatgaac

SEQ ID NO: 1658 - DNA, 1547 bp, Homo sapiens
acaatttctttttatctttttatcatcaagtagtttctaagatagacttgaggggagcaattcctaaacaaattaacgagtttgtggggcttttgcagtcatgtaagatgcatctattaaaaactgaaccaggtaatgcagaagtagtggggagaaaaggaggaatgaatcaacatagtttaaccagaaggatatgaagtaaaagggagagaaagaagcaaaatattcctgcaagtttacatgttgggtgatgaggaaatgatggcttcattcttccttttgtcaatatcatttctcaaattgtctttcccttctccttggatgatttggtcagtgtttcctccttgactttctcttgctttttctaaaggcttagttcacaagtctccttctgtttcctgtctggatttagtgtccctcttacacaatttcttggtttcctttgcaggccaatgtcataacactcatcacactacatcacattatttgttcacacctgtttcttttactacattggattccttgagtagaaagcacagaaatgtctagttcttagcacgacgtttggcatgtggttgatttaagttgataaccatagaaagtttaatgaatgagtttcttcttttctttgcaataattaatagtctaagacctggatatttactacttggaaagttagttctagagtgctctacaatggtggaatagctttcttctcttttttatataacctgtgtgacactgttccagcattagataaaatattagatttaaagtggagtgagaggaagttttaagcttattttattgttctctttggggttctatgaaatctcagaaaggagaaatgcagaagatgatggttgctgccacatttttcgattttcaaagatcactctggccatttatttctggggtatctggaaaatttagttgtggtccccaacatgctgaatttttacattctaggaaacactagtgagaattagacatgaaatgatgaactaagaaagaaactcaaattctcttaatatttaagtatttaaatttagacatgaagatttttaaaaagtcgtatccctttccttgaatccttatataataagcatttaatttacctgagcttcagctaaaaatgaggataacagctgttgtatcaaggaatttaaagtgctctgtgttaaatcccagtgtgtatgacatttacgttgctaaaataatttgagagctctggtctctaaagtagattgctaaaataaaatgtactatgattaacaaaacccaaatattacagagacagattttagggatagtattgttggctttagtaagaagtatgggagatactagatttgtcattaacggtttttctttaacctggaacatcctacttttattctctctcagtctgaagtttctgagtggatatgtacctaactgtgttgcttgttttcaaagagggatattaaaaagtttcattatgtagcccatgaaaaatgtgtattttcttagtagtaaatattgatcattatcaatttatgaagaag

SEQ ID NO: 1659 - DNA, 358 bp, Homo sapiens
gggttactcacaaacagaaaatactattaaagaaagtttggcaaatgtctttaaacttttcactgccttaagtatgtaagattcatagtttttattctcccacaatgatgtagttacagttaatatcttgttgtatatatcatccgatatgtaggaatgtggcattttcttttttctttcttaaatctttctacattttaagtcaattattaaaagactattagactagtcttttaaaattcttccacaataccgaaaaacctgaggataagctttttgtttttgtcaagctgctttatctctaatgttaaacaacttattagtttagggatagtgtttatttttctggtaaataatg

SEQ ID NO: 1660 - DNA, 22 bp, Homo sapiens
taattttaagaagaactgtggg

SEQ ID NO: 1661 - DNA, 196 bp, Homo sapiens
aaggaaattactggttaatttctaattataatacatgaatactaagtacaaaatgttaataaaaattgtcagtagtattttaacatactgcaatattcatcttcaaattcatattataacctacaaagcaatcatgttggggagctttactccctttccaagagtgcttccatggaccaaaatgattgcaaaaaag

SEQ ID NO: 1662 - DNA, 617 bp, Homo sapiens
cctagaacacaaggatttttgaaacagaaaggacttgagagatcatctctacaaactcattcagttaagtttttccctctagtttctgattcttatttacatggcatcatagttattgatggagaagtcaggaactcaggtagtttttcaaaataaatatcttaatacatagcagtgaatacaaggggttttgagtgacttatcttccgattacattctcgtcttcaccaatgctcatagaatgtgaccattaacatgttacagtccacacaaaattttgcagataacacacaaatgaccaaagttacattatgaatatctagcagtgtggtggctgccatcttcctcagctctgctctgttcttaattttccaagaaccctccagggatcattaaaagaaggaactgtaaatatccacagatagttttgtattatataaatgtaaactgtgtatcagaaagtgggcaagaaactattaaaaaatcataatttattcagcatacctatgcataaacaaaattaatacttatatgattttctggtttcagtatgtataacactaacatcttttgtttgccaaacataatgatatatcactttagattgagaaacatgc

SEQ ID NO: 1663 - DNA, 182 bp, Homo sapiens
gcttcctgttgtctcccttctcaccttcctcacccattctcgttcagaagagaatataatacttattctttgattttattaatacatattgatgttctgaattgtaatatgcattttaataactaaattgggatttgctaaaaatagcattttaatatcttttgcagttcttcaaacatctg

SEQ ID NO: 1664 - DNA, 341 bp, Homo sapiens
gtttaatcactatattcatgcattttaaaagtcttggattaaatgaatagctttacatctagttttaatattcatcacaagttttttgggtattaactaaggacttctgtttgcatgtaatttaacaatttgattaatatgctttgcagttttactttgtattttatcttggatctgagatcttggaggcaaattctagctaatgcctctttgcagagattttacaaagccataagaagagaaatgaaaattctcaaaattattacaggaagcttttgaaaagtgcaatctagttggatcggtagcattaggatacaactttttgacactttgttagggtt

SEQ ID NO: 1665 - DNA, 352 bp, Homo sapiens
tagtttggggctgctgaagtggctaatagtttaaggcagggtactggaaaggaggaagctgtacagagggaagcatcagaagtctgtgtggggtatactacatgttcttggccaaaggcgagggtccatttatacagggtaagactccatgtgttgtaatcaagagtggctgctggttgcctgaaaatgaaactgaaatgccaggggttgttggaattgcaaagcagtcagagcagagagaccattcagagctctccaggcattcagctgagatcccagaaatgccatgactttggtgtaaggaaaacacactaaatatggatcacatcatatgactaaggataaactcaag

SEQ ID NO: 1666 - DNA, 873 bp, Homo sapiens; identical to SEQ ID NO: 579

SEQ ID NO: 1667 - DNA, 85 bp, Homo sapiens; identical to SEQ ID NO: 580

SEQ ID NO: 1668 - DNA, 974 bp, Homo sapiens; identical to SEQ ID NO: 581

SEQ ID NO: 1669 - DNA, 178 bp, Homo sapiens; identical to SEQ ID NO: 582

SEQ ID NO: 1670 - DNA, 103 bp, Homo sapiens; identical to SEQ ID NO: 583

SEQ ID NO: 1671 - DNA, 97 bp, Homo sapiens; identical to SEQ ID NO: 584

SEQ ID NO: 1672 - DNA, 85 bp, Homo sapiens; identical to SEQ ID NO: 585

SEQ ID NO: 1673 - DNA, 57 bp, Homo sapiens; identical to SEQ ID NO: 586

SEQ ID NO: 1674 - DNA, 1408 bp, Homo sapiens; identical to SEQ ID NO: 587

SEQ ID NO: 1675 - DNA, 287 bp, Homo sapiens; identical to SEQ ID NO: 588

SEQ ID NO: 1676 - DNA, 477 bp, Homo sapiens; identical to SEQ ID NO: 589

SEQ ID NO: 1677 - DNA, 69 bp, Homo sapiens; identical to SEQ ID NO: 590

SEQ ID NO: 1678 - DNA, 774 bp, Homo sapiens; identical to SEQ ID NO: 591

SEQ ID NO: 1679 - DNA, 977 bp, Homo sapiens; identical to SEQ ID NO: 592

SEQ ID NO: 1680 - DNA, 48 bp, Homo sapiens; identical to SEQ ID NO: 593

SEQ ID NO: 1681 - DNA, 795 bp, Homo sapiens; identical to SEQ ID NO: 594

SEQ ID NO: 1682 - DNA, 500 bp, Homo sapiens; identical to SEQ ID NO: 595

SEQ ID NO: 1683 - DNA, 765 bp, Homo sapiens; identical to SEQ ID NO: 596

SEQ ID NO: 1684 - DNA, 268 bp, Homo sapiens; identical to SEQ ID NO: 597

SEQ ID NO: 1685 - DNA, 141 bp, Homo sapiens; identical to SEQ ID NO: 598

SEQ ID NO: 1686 - DNA, 1608 bp, Homo sapiens; identical to SEQ ID NO: 599

SEQ ID NO: 1687 - DNA, 1158 bp, Homo sapiens; identical to SEQ ID NO: 600

SEQ ID NO: 1688 - DNA, 520 bp, Homo sapiens; identical to SEQ ID NO: 601

SEQ ID NO: 1689 - DNA, 152 bp, Homo sapiens; identical to SEQ ID NO: 602

SEQ ID NO: 1690 - DNA, 99 bp, Homo sapiens; identical to SEQ ID NO: 603

SEQ ID NO: 1691 - DNA, 77 bp, Homo sapiens; identical to SEQ ID NO: 604

SEQ ID NO: 1692 - DNA, 181 bp, Homo sapiens; identical to SEQ ID NO: 605

SEQ ID NO: 1693 - DNA, 301 bp, Homo sapiens; identical to SEQ ID NO: 654

SEQ ID NO: 1694 - DNA, 195 bp, Homo sapiens; identical to SEQ ID NO: 655

SEQ ID NO: 1695 - DNA, 3524 bp, Homo sapiens; identical to SEQ ID NO: 656

SEQ ID NO: 1696 - DNA, 125 bp, Homo sapiens; identical to SEQ ID NO: 657

SEQ ID NO: 1697 - DNA, 310 bp, Homo sapiens; identical to SEQ ID NO: 658

SEQ ID NO: 1698 - DNA, 999 bp, Homo sapiens; identical to SEQ ID NO: 659

SEQ ID NO: 1699 - DNA, 561 bp, Homo sapiens; identical to SEQ ID NO: 660

SEQ ID NO: 1700 - DNA, 152 bp, Homo sapiens; identical to SEQ ID NO: 661

SEQ ID NO: 1701 - DNA, 133 bp, Homo sapiens; identical to SEQ ID NO: 662

SEQ ID NO: 1702 - DNA, 134 bp, Homo sapiens; identical to SEQ ID NO: 663

SEQ ID NO: 1703 - DNA, 452 bp, Homo sapiens; identical to SEQ ID NO: 664

SEQ ID NO: 1704 - DNA, 170 bp, Homo sapiens; identical to SEQ ID NO: 665

SEQ ID NO: 1705 - DNA, 254 bp, Homo sapiens; identical to SEQ ID NO: 666

SEQ ID NO: 1706 - DNA, 198 bp, Homo sapiens; identical to SEQ ID NO: 667

SEQ ID NO: 1707 - DNA, 207 bp, Homo sapiens; identical to SEQ ID NO: 668

SEQ ID NO: 1708 - DNA, 1049 bp, Homo sapiens; identical to SEQ ID NO: 669

SEQ ID NO: 1709 - DNA, 75 bp, Homo sapiens; identical to SEQ ID NO: 670

SEQ ID NO: 1710 - DNA, 537 bp, Homo sapiens; identical to SEQ ID NO: 671

SEQ ID NO: 1711 - DNA, 616 bp, Homo sapiens; identical to SEQ ID NO: 672

SEQ ID NO: 1712 - DNA, 1297 bp, Homo sapiens; identical to SEQ ID NO: 673

SEQ ID NO: 1713 - DNA, 71 bp, Homo sapiens; identical to SEQ ID NO: 674

SEQ ID NO: 1714 - DNA, 135 bp, Homo sapiens; identical to SEQ ID NO: 675

SEQ ID NO: 1715 - DNA, 366 bp, Homo sapiens; identical to SEQ ID NO: 676

SEQ ID NO: 1716 - DNA, 130 bp, Homo sapiens; identical to SEQ ID NO: 677

SEQ ID NO: 1717 - DNA, 106 bp, Homo sapiens; identical to SEQ ID NO: 678

SEQ ID NO: 1718 - DNA, 387 bp, Homo sapiens; identical to SEQ ID NO: 679

SEQ ID NO: 1719 - DNA, 212 bp, Homo sapiens; identical to SEQ ID NO: 680

SEQ ID NO: 1720 - DNA, 129 bp, Homo sapiens; identical to SEQ ID NO: 681

SEQ ID NO: 1721 - DNA, 984 bp, Homo sapiens; identical to SEQ ID NO: 682

SEQ ID NO: 1722 - DNA, 352 bp, Homo sapiens; identical to SEQ ID NO: 683

SEQ ID NO: 1723 - DNA, 560 bp, Homo sapiens; identical to SEQ ID NO: 684

SEQ ID NO: 1724 - DNA, 124 bp, Homo sapiens; identical to SEQ ID NO: 685

SEQ ID NO: 1725 - DNA, 241 bp, Homo sapiens; identical to SEQ ID NO: 686

SEQ ID NO: 1726 - DNA, 66 bp, Homo sapiens; identical to SEQ ID NO: 737

SEQ ID NO: 1727 - DNA, 978 bp, Homo sapiens; identical to SEQ ID NO: 738

SEQ ID NO: 1728 - DNA, 68 bp, Homo sapiens; identical to SEQ ID NO: 739

SEQ ID NO: 1729 - DNA, 47 bp, Homo sapiens; identical to SEQ ID NO: 740

SEQ ID NO: 1730 - DNA, 633 bp, Homo sapiens; identical to SEQ ID NO: 741

SEQ ID NO: 1731 - DNA, 116 bp, Homo sapiens; identical to SEQ ID NO: 742

SEQ ID NO: 1732 - DNA, 340 bp, Homo sapiens; identical to SEQ ID NO: 743

SEQ ID NO: 1733 - DNA, 125 bp, Homo sapiens; identical to SEQ ID NO: 744

SEQ ID NO: 1734 - DNA, 208 bp, Homo sapiens; identical to SEQ ID NO: 745

SEQ ID NO: 1735 - DNA, 713 bp, Homo sapiens; identical to SEQ ID NO: 746

SEQ ID NO: 1736 - DNA, 97 bp, Homo sapiens; identical to SEQ ID NO: 747

SEQ ID NO: 1737 - DNA, 197 bp, Homo sapiens; identical to SEQ ID NO: 748

SEQ ID NO: 1738 - DNA, 586 bp, Homo sapiens; identical to SEQ ID NO: 749

SEQ ID NO: 1739 - DNA, 122 bp, Homo sapiens; identical to SEQ ID NO: 750

SEQ ID NO: 1740 - DNA, 246 bp, Homo sapiens; identical to SEQ ID NO: 751

SEQ ID NO: 1741 - DNA, 442 bp, Homo sapiens; identical to SEQ ID NO: 752

SEQ ID NO: 1742 - DNA, 113 bp, Homo sapiens; identical to SEQ ID NO: 753

SEQ ID NO: 1743 - DNA, 19 bp, Homo sapiens
cctctctaaggctgagaag

SEQ ID NO: 1744 - DNA, 94 bp, Homo sapiens; identical to SEQ ID NO: 755

SEQ ID NO: 1745 - DNA, 211 bp, Homo sapiens; identical to SEQ ID NO: 756

SEQ ID NO: 1746 - DNA, 542 bp, Homo sapiens; identical to SEQ ID NO: 757

SEQ ID NO: 1747 - DNA, 40 bp, Homo sapiens; identical to SEQ ID NO: 758

SEQ ID NO: 1748 - DNA, 63 bp, Homo sapiens; identical to SEQ ID NO: 759

SEQ ID NO: 1749 - DNA, 272 bp, Homo sapiens; identical to SEQ ID NO: 760

SEQ ID NO: 1750 - DNA, 23 bp, Homo sapiens
cccaagatgcttattttatttca

SEQ ID NO: 1751 - DNA, 105 bp, Homo sapiens; identical to SEQ ID NO: 762

SEQ ID NO: 1752 - DNA, 774 bp, Homo sapiens; identical to SEQ ID NO: 763

SEQ ID NO: 1753 - DNA, 68 bp, Homo sapiens; identical to SEQ ID NO: 764

SEQ ID NO: 1754 - DNA, 27 bp, Homo sapiens
atacttcttccttcatcgcagaggtta

SEQ ID NO: 1755 - DNA, 66 bp, Homo sapiens; identical to SEQ ID NO: 766

SEQ ID NO: 1756 - DNA, 546 bp, Homo sapiens; identical to SEQ ID NO: 767

SEQ ID NO: 1757 - DNA, 36 bp, Homo sapiens; identical to SEQ ID NO: 768

SEQ ID NO: 1758 - DNA, 121 bp, Homo sapiens; identical to SEQ ID NO: 769

SEQ ID NO: 1759 - DNA, 31 bp, Homo sapiens; identical to SEQ ID NO: 770

SEQ ID NO: 1760 - DNA, 47 bp, Homo sapiens; identical to SEQ ID NO: 771

SEQ ID NO: 1761 - DNA, 13 bp, Homo sapiens
agccgaatccatc

SEQ ID NO: 1762 - DNA, 74 bp, Homo sapiens; identical to SEQ ID NO: 772

SEQ ID NO: 1763 - DNA, 27 bp, Homo sapiens
tgaacccagagacaaatcagtgagaga

SEQ ID NO: 1764 - DNA, 49 bp, Homo sapiens; identical to SEQ ID NO: 774

SEQ ID NO: 1765 - DNA, 78 bp, Homo sapiens; identical to SEQ ID NO: 775

SEQ ID NO: 1766 - DNA, 776 bp, Homo sapiens; identical to SEQ ID NO: 776

SEQ ID NO: 1767 - DNA, 216 bp, Homo sapiens; identical to SEQ ID NO: 777

SEQ ID NO: 1768 - DNA, 660 bp, Homo sapiens; identical to SEQ ID NO: 778

SEQ ID NO: 1769 - DNA, 160 bp, Homo sapiens; identical to SEQ ID NO: 779

SEQ ID NO: 1770 - DNA, 133 bp, Homo sapiens; identical to SEQ ID NO: 780

SEQ ID NO: 1771 - DNA, 536 bp, Homo sapiens; identical to SEQ ID NO: 781

SEQ ID NO: 1772 - DNA, 362 bp, Homo sapiens; identical to SEQ ID NO: 782

SEQ ID NO: 1773 - DNA, 298 bp, Homo sapiens; identical to SEQ ID NO: 783

SEQ ID NO: 1774 - DNA, 66 bp, Homo sapiens; identical to SEQ ID NO: 784

SEQ ID NO: 1775 - DNA, 24 bp, Homo sapiens
agtccccaaaccaacacgcctttc

SEQ ID NO: 1776 - DNA, 36 bp, Homo sapiens; identical to SEQ ID NO: 786

SEQ ID NO: 1777 - DNA, 722 bp, Homo sapiens; identical to SEQ ID NO: 787

SEQ ID NO: 1778 - DNA, 157 bp, Homo sapiens; identical to SEQ ID NO: 788

SEQ ID NO: 1779 - DNA, 112 bp, Homo sapiens; identical to SEQ ID NO: 789

SEQ ID NO: 1780 - DNA, 277 bp, Homo sapiens; identical to SEQ ID NO: 790

SEQ ID NO: 1781 - DNA, 1095 bp, Homo sapiens; identical to SEQ ID NO: 791

SEQ ID NO: 1782 - DNA, 168 bp, Homo sapiens; identical to SEQ ID NO: 792

SEQ ID NO: 1783 - DNA, 354 bp, Homo sapiens; identical to SEQ ID NO: 793

SEQ ID NO: 1784 - DNA, 97 bp, Homo sapiens; identical to SEQ ID NO: 794

SEQ ID NO: 1785 - DNA, 356 bp, Homo sapiens; identical to SEQ ID NO: 795

SEQ ID NO: 1786 - DNA, 242 bp, Homo sapiens; identical to SEQ ID NO: 796

SEQ ID NO: 1787 - DNA, 196 bp, Homo sapiens; identical to SEQ ID NO: 797

SEQ ID NO: 1788 - DNA, 694 bp, Homo sapiens
tgggttgataagattatctagatcactgctaaatctccctgccactttatcctgttgatactgagacacctaactctcaaatataatcttccaaaaagcaatcctttacaaggcgactctgaaagactctttgtgctagcaaacaatacccaaagtgtgccttccagagagacaatatagtaaagcagcatattaatcttgccccaaatcctatttcatgtcttccggacattgcagaggggagatgggtggaaacaatggatccattgagaattacaggctgacctccaactgagacctctacctgggtgactacatttggatggagaacaagtactttggccctagccacattttgtttcctgttccctgactgaggttggctgcagttcagttatgaactctgctagcaagaccgtgacactggaaaagacgttaaaagtgcccacccattcaggatttaattaatggttgcacaggaaccaacttcttcccactcggcagagaggaaagggttggcagctgaccactcctcaggctgccagctctcagtcctttgaggacctcagccatgcacctgtgccaagaggttggcagctgaggttcgatgatccaaggcctcacaaaatctcatccacgaatcaacctgcttatcgttatttcctgcaaaacttcaaaaccataaaattctttc

SEQ ID NO: 1789 - DNA, 228 bp, Homo sapiens
cataaacccttcttttaccctcaaaatatcctttgttgttgctagagcatctgttgccttcttcagtaactgtcttcctttctcttgtcattttatagttaccatttgttgagtattactaggtaccagctacatccctttagaaaacaaaaccttataaaaaattcaaaacaattctggttactaaagttactcctgactaggtcaattgccaacgaatgaatgaca

SEQ ID NO: 1790 - DNA, 177 bp, Homo sapiens
atcatacatcttttctgcttaggcttctcttggttgtaattttgtaggattccttggttagtgatggtccacatctgtgagtcatgagcccagtgagggcagaaaacttgtgtatatctattaaactttgtagaatccagtataaatggcgctaactttcattgaataaatgattaa

SEQ ID NO: 1791 - DNA, 797 bp, Homo sapiens
agtcaacataataggctctttacgaatcccgtgccattgtatgaaatgtctgtgagtcttggttcacgtgcataattaggagagtcagtaattatttcatgtcttaagatgcagataattacaaaaattcagattaatatgtggaaaatacaaagtatatcccttgctcatagcagatgagcattgatgtcagttgttatcattatatcatcattgcttctttctgttctgcctacttctgttgctagtctttgggaactctaacatcttaatacattgttattcttggtttaacagacaagtcctaggaaaattttctgaaaataagcaaaacattaaaacttcatcagatgattcttaaagcagattttaaaaaatatttcataaaatccacaagacatgaaagaacagtgtgtccacaattctttcctctaagtattttttcctattaaccagtaggatagaaagaaggggataataccaaattagtttttcctaccttctgccctctccaaccctagccttatcatggatatttttccctcttgggatagagatgactgcaaaaacagatgttgctgctcctgccaaactcttaaaagtaggttgaacaagtcacgtgtaatgccaatggcagagccccatcactgcgactgttttatgtaacctgagttcagaatcttgaactcttgtccacagaaacaggcttgctcctttgaggaccctgtcattgacatcacaacaacaataggtgtgagaatagatagtcctcattgcaagcatattctttttattta

SEQ ID NO: 1792 - DNA, 483 bp, Homo sapiens
cattcaacgttattcttaattcatggttcaaagcagagtaagcaatagttcagttccctgaagatatttgacttttggaaagggaatgggtcagatagttttaaaaatggataatttcataatgtcaccttttccctacacagagggaggatgatagatttcataatgtcaccttttccctacacagagggaggatgatagatttcataatgtcaccttttccctacacagagggaggatgacaatattcttgtgttttttatggtagcagagcatttttttggggggaaagggaacttcagataatatcacatatatgaattaagaaatgtttcttactaggcttttattttaaactcactactcatcaaacttgtccttaagctcaacaaaaatatctacctgtcaggcaaaaatcaatatttttataatacagcaaaaagtatgcttacctaaaaattgtcccttaattgacctaacttt

SEQ ID NO: 1793 - DNA, 241 bp, Homo sapiens
cagtttctatacctgtgaaatgggggagataaatgagctctaaattctcttccagttcttcatttctatcagttttcaagtggactcctttctgcttaatgccataattttgtgatactattattgtggaggaggttaaaaacacttttgcatgatcctgctgtgcatatatgatattcacaattacagactgaaacaagcattttcaaatgctaaccggatcaatgtaaaagtgaggttc

SEQ ID NO: 1794 - DNA, 575 bp, Homo sapiens
aatattaggactatatgaccttgtaacattgccttctgtatttttaagtaaagtccatttgggtcaggaacaagatatttttctgtgcttggagctcacattgcagttgacactcaatacatactcgtcaaaagaataaatgcattttagttagcaaaaatgcaagaaaaacattagttaaggcagaccaaactatgaaagggtgactctgcatgtcagagggacttatagcactaaaacaaatataacgtctaagaaaatgtgaaatgtctatcttctcagcaggcctagctgtgagtaataaaagccctcacaatatgggcatcataacaaagaaagaaatttgctgaaaacaataacagttatttctttattggtttcagactatgtggatatatacataaacaacacgttaatatttaaatatctggaatcaatcttaaaaaatacaaagactgtgaattaataaaattagccattaaacagaaatcagaggccaagtaaagcacaaacaatgaacctaacttcttgagctgggccaaaaacatcattctagtggcttttccctatataac

SEQ ID NO: 1795 - DNA, 686 bp, Homo sapiens
ggttttctgttgtacaaaacctgaagttaccatttcatttagtcaaggcaaccaatgcatttctcgcaatttataaggatgttgacagttggcaccatccattaaaaaatgattaattcacctcttggcacctaatgaccaagcaggaaataggatagcagctgtcattctgtcttgactgcacatttctctgtaaacactcacacatgaagccttgggagtagcttgcgaaaggcatattccaatgggtatttcttcagcttttctattatacactctttttttaaaaaaagtatttttttaaagcacagtaatctagctcttgcatgtgggtgctttactgagaaaaatggtcaattgttttcaatgtttctgctccccaccctccaaacctgagtgagtgcaggtgctcctggcttgcctgagaatgagaataaactaagatcaccagcacgtggggtctctgcctgtgaattcttatcttgaccaactaatactttactggtgaaatgtacatgcaggtaaaatgtacatgcagaagatgagagaggcaaagggtcacttgattattagctaaatttggcccaaccactgcacagctgcatgggatggcatgcaaccacaggcactcctttgtctaagaaaacacatccaagcacttcctattttattttttggcctcagac

SEQ ID NO: 1796 - DNA, 771 bp, Homo sapiens
tacttagaaaccattgtcctgcatcttactctgcagccagcttggctttcaaaaggcatggggacaggggagagaagacctcctttctaggaagaggagactctcagctgctaggatatggagagtctgcaggaactgagggacacactgaagaacagtagagctaggccttctgccaagtgggcgctgcccgctccttcctgtagtccagccacatgaaagaagggataggaagagacaaagggggaactgggcctgggccttgtctccatgaggaacagcccatgtctctggttcatcttcagagatcatctccccaagtgctgtgactgttaatggaccactccttgtactgcacaccagttttaaaaagtctatttgccatcagaatggagggttgaggaagaccacgtggtttgatctagaatagcattttccattgtgtggcatgggcattgcagtgcaacatgagacaatgtcaagcgatctcctaacctgtatggggcagagatggccttaatgggtaggccaaggctgtgtgaagaagagaagaacaggggttgaatgaaacaggggtgggaagaagagacatgcaggatctccttttcctagatattggtgtctcattttaatcccaattataatgttgggaacaatttttaaacctaatttgttcataaaaccaaccaacaattacaaaaatgactttttgttattgaatgaactgattacacacttgactgtgtccctcattaaacaaagtttaagagc

SEQ ID NO: 1797 - DNA, 587 bp, Homo sapiens
taatagtataaggaaacacttaggacactctgcaagtatctcttcatgacgttcaaacaatatggtggttgtagatgagtaaggcactatgccactgtggaaactaacaaatagctgggcagattcagagaaacacactgtagatattgcttttgaagccttttctacaaaaattggttgagcaaatgtcacttacatcatgatcctcaatgtcgagctctatcagcaaaggcacaattaagtggacataatttgctttttctctgtgcaattgtgaattgggattcaagataatcttacataacatcccatctttattctaaacttagtgatattaagctgactattcttgagaaactatgaacaggtcacttagtgtcattgaggaattcttttattttcagatgagttttgtaaaccatttgtagtgactgtattttattttgtaattaaaattaacaaatgtaaatatttggcttttgcggctaccctttatgccatgttctatcgattctatgtttaaaggagttataaaacagttgattttaaaataatttctttttttagagaaaataatttcttttact

SEQ ID NO: 1798 - DNA, 461 bp, Homo sapiens
gaaatattttttacagcaaatcatatttttacttaaatagatttaaaagttggtagaggtgatacgtgcttatggggaaaactcatgatgatagcaattgagtgacaacagtttgagaatcacctctcaggagtctgtggtcctctcaggaggaagaaggtgtcagtcacccagatccaggggtgactgacgaaaaccgtcttaggtgttgaccctcagcaccagtggagaccatagaggtattcaaggaattaagatcttaggggaaagataaggtaaaacagacaaagcatggaatccttatgcatatttttacattttcaaagataaaaccatatagcacataattagatgaccttttccacatcacacttagcaataatgggttctgtgttataaattttcataaaccatgtcttacataatacatgctggtgtattgtgaggtattgtggtgtatt

SEQ ID NO: 1799 - DNA, 433 bp, Homo sapiens
ccaaaagctataaagaaagacaactttttttttttcctggtgtggtatcgtctttctaccgttagcatatagaacccatgccaagagaattctcgctcatgctttccctccatcttaatggacttggagttgcaggctccagatactctggtgtgattgcccaggaaatactatcatcccagagcaaagcaattattacagataaagacttagatatgcaacaagtctttaagtatactttgttgaaaagactaggtaaggatttattatttctcaaccccagttccccatatgaaattcccagctctgcccgtaatttatcattgttaaatcacttattgtcaaactccattcacatgcatctcagggggcaaaaagtagagttctaaggcctgcatgcccttctttttctttctctatcccagggtaacgc

SEQ ID NO: 1800 - DNA, 28 bp, Homo sapiens
ccaaaaggtataaagacaattttttttt

SEQ ID NO: 1801 - DNA, 570 bp, Homo sapiens
tatctttttttctgtcacgtattttatctgcatctattccattttccattcttaatcataattttttgtttgctaaatagcaataaattatataaaaattctcttaactataaagatacgcatatgaacttatgtagacacacatgtaatcacagatgcagggaaaaatacagtattttcagatcaattggacataactttgcccagttcttattctccactggtttaatgattcaaaatttcaaaaagccaagaacaattactttttatttttttcatgttttcctgcccatccttcccttccccctctttatttttacaaaaatattttactagaatgacttttaaatgtaaaaatacatttatggtagttttatcttagatgatttccacaaatgttctcatgacaattacaggggaacaaaatagtgtgtcctcaagagggtaaatgtgtcatctgtttcatcctagcatttcatactttgatttcttcaaaggcaaacaagaaaaatcactagttgttgaatagcttatctatctttcctcttctcaatgaagttactctgtaga

SEQ ID NO: 1802 - DNA, 134 bp, Homo sapiens
tgaaccgctgcacccaaccattctctaagagtcctgagtgacatttatacagttaaattacctttgaaattatggacttttcactaacttattcaagaacttaacaagctgtcaaagataaagaaatggaatac

SEQ ID NO: 1803 - DNA, 96 bp, Homo sapiens
cacatatattttgacttttctctataatccatggttttattcaacattttatctcaaaatattacttagagaagcaagtgagaacacataataggc

SEQ ID NO: 1804 - DNA, 561 bp, Homo sapiens
gaaataacttgctgtttttcagaaggcaacggggttgtagtagagaaaatttttttttttcctgttgataaaatggccacttctctaggccaagccaagcagattgagagaagttcctaagcattatttctctgggattcaagaactcatgactttaattagaatgggaacgaagtatgctgctaaatttaacaaaccactgtctagttgattatgctgagctggctaatccagcttgaattgagactttttaaagaagtaaaattgggttacattcatcaaagaagttgaggaataaagtagaatttatgtaaatatgccctttataaccacttctcaaaaaattacaggaggacacagtattataattactttggttttggcaaaatagtgtgatgttttttcaattgagaacaattttaaactcattaatgcctaccaacagctggcttctgatgactgaaaatactcttattcagtgagggtcttgtcatattatgatttattaatattaacatagcaagaagacagatggatttttttattaccactgtttactcc

SEQ ID NO: 1805 - DNA, 1191 bp, Homo sapiens
gctgttagctcaatcctagggcaaatttaaacgtatcagttggtaggaaaaagccacaagtggcctttaattttccaagcagctctggtagtatgtacagagcattataaatgatggtcctttctccctcaaaacactgctgtgttttgtcatttagctcctcctagatattttttaaataccagaaatgggtatgtagcattcccaaagagcgggctgtagcttttcatggactgattcagcaagcaccaaaagttacgaggttgataacatgtgaagggcatccatatttatcttttctatgagttgtttccttgcatgaatttcaattacatggagatcttaaacagtccatgttgccctattttcataatattccttggaatacttttcaagttgtcaattttagtctcagagactctctataagcagaatatagtttacacaaaataataaagacacacgcacaccaaataaacataacatgaagcttgccagtccagcagcaagcacaattgcgagcaccatttggcttctcatagaactcctggcttgggtgttcacagggttagtcgaactgtgaactccacgcaacagttaggcaaggtattccatccagatttgaaagttctgagtctcagtctttgacctgaagtcataaaggacctttttaaaacagatgtctttgcccttgaaccctttgaagttcaaaagggggtctctccccaaatcgacgtatctcagtgtgattcaccacttcttgcatataacagtgcaaatcaaagattttttttaaagtcagatttgtcatcgcttcccattttcaagtgcttcagagtaccacgtgcttcagggaattgagctagaagcctactggcaacctgtctgttcctcagagcaggctccttcatcacagcggcagctcacagatggttctcggtgctcagctcctggtctcaaaggcagctggtctctctagaggttgaaaggtaagcccctggccctaaggtgctggggaggacaccaagatcagatcttccttgtgcatgacttgcagcattgttttccgtaaaacttgtggttgcagacaccatgctgaggaactaggtgacaccagttgaagaaatctacgcaggatggatcctctaaaataagaaaatatatttagcatgttggctagggtgtctatcc

SEQ ID NO: 1806 - DNA, 754 bp, Homo sapiens
tttggtgatttgcatattatgatttattaatattaacatagcacctttttcttaaggtgagggcctacagaacaaaggtcttgggcccacctcccttgtgcctctatgtggtttttcccattaaacattgggactttggtaggggggtgaggtaggggcaggatttagatgccaagaaaagactctgaccattagcaaaattaaatgatttgtttttaaaaaatgtcacatctaatccaagatcaatgtctgatcctccctatgtagcctgggagctaccatggaattcagtgtccagggaaataccctaaaatggtgctttagggatcccctaaggatattgttgtaccactagtaccgctggttctgattgagaagggctgtcagaggggagcattaagggagggtgtgctgctggtccacgaactataatttcaggagcaagaagcctgatgtattgggagtcaagccaccttatttgcctgcaaatgggttgagattaactgaaaaagccgggtctccaacagtctgtgtaggtttaagtcaatctcaaccagtttgcaagtaaataaatttaagtcaacaccagtcctttctaatttctttagttgttcaatgagcaggacagatgtgattatttcactgtacatcaagaattcttactcagatgggcctcaggagataggaaatgcaagtgaatgggtatgtaaacataagtgcatgttgtaggagcaagggcccagtcatttcactg

SEQ ID NO: 1807 - DNA, 268 bp, Homo sapiens
attttactgtatttttaaggcacagttttgactttaaaaatatttagagtatacactacacataattcagaaatgcttagagttccttcttcaagccttgatttttctgcctaaaattcctttttatacatccccttcatgtaagtaagtcaggcaggagaagtgagatgtattactattctgtcagtataagtgctttttttgattataattactaacagctggttgtttgagcttctactgtgagtcaggtatttcatttacacta

SEQ ID NO: 1808 - DNA, 280 bp, Homo sapiens
ttccactgtacaatgctgcctgcccccatctgaagatgtgggattccatgaggagcagcttattagtattgagtgcctgctcatccttaacttaatatgactagtctgcagcccaggtagcttccagacacgtaaacacccagtttcaatgcagtgtgacacaagtctctgggtggtatgactgctttagggccttctctcttttctgaagagaattttatgtataatatgtacagtgcaaccataaggatggcttccccaaggtggagatccaaccaag

SEQ ID NO: 1809 - DNA, 3310 bp, Homo sapiens; identical to SEQ ID NO: 865

SEQ ID NO: 1810 - DNA, 228 bp, Homo sapiens; identical to SEQ ID NO: 866

SEQ ID NO: 1811 - DNA, 33 bp, Homo sapiens; identical to SEQ ID NO: 867

SEQ ID NO: 1812 - DNA, 249 bp, Homo sapiens; identical to SEQ ID NO: 868

SEQ ID NO: 1813 - DNA, 1100 bp, Homo sapiens; identical to SEQ ID NO: 869

SEQ ID NO: 1814 - DNA, 251 bp, Homo sapiens; identical to SEQ ID NO: 870

SEQ ID NO: 1815 - DNA, 2497 bp, Homo sapiens; identical to SEQ ID NO: 871

SEQ ID NO: 1816 - DNA, 154 bp, Homo sapiens; identical to SEQ ID NO: 872

SEQ ID NO: 1817 - DNA, 769 bp, Homo sapiens; identical to SEQ ID NO: 873

SEQ ID NO: 1818 - DNA, 1593 bp, Homo sapiens; identical to SEQ ID NO: 874

SEQ ID NO: 1819 - DNA, 23 bp, Homo sapiens
cagtcatattgttcctcatttgc

SEQ ID NO: 1820 - DNA, 143 bp, Homo sapiens; identical to SEQ ID NO: 876

SEQ ID NO: 1821 - DNA, 266 bp, Homo sapiens; identical to SEQ ID NO: 877

SEQ ID NO: 1822 - DNA, 405 bp, Homo sapiens; identical to SEQ ID NO: 878

SEQ ID NO: 1823 - DNA, 68 bp, Homo sapiens; identical to SEQ ID NO: 879

SEQ ID NO: 1824 - DNA, 948 bp, Homo sapiens; identical to SEQ ID NO: 880

SEQ ID NO: 1825 - DNA, 489 bp, Homo sapiens; identical to SEQ ID NO: 881

SEQ ID NO: 1826 - DNA, 862 bp, Homo sapiens; identical to SEQ ID NO: 882

SEQ ID NO: 1827 - DNA, 606 bp, Homo sapiens; identical to SEQ ID NO: 883

SEQ ID NO: 1828 - DNA, 141 bp, Homo sapiens; identical to SEQ ID NO: 884

SEQ ID NO: 1829 - DNA, 43 bp, Homo sapiens; identical to SEQ ID NO: 885

SEQ ID NO: 1830 - DNA, 309 bp, Homo sapiens; identical to SEQ ID NO: 886

SEQ ID NO: 1831 - DNA, 175 bp, Homo sapiens; identical to SEQ ID NO: 887

SEQ ID NO: 1832 - DNA, 179 bp, Homo sapiens; identical to SEQ ID NO: 888

SEQ ID NO: 1833 - DNA, 98 bp, Homo sapiens; identical to SEQ ID NO: 928

SEQ ID NO: 1834 - DNA, 450 bp, Homo sapiens; identical to SEQ ID NO: 929

SEQ ID NO: 1835 - DNA, 198 bp, Homo sapiens; identical to SEQ ID NO: 930

SEQ ID NO: 1836 - DNA, 452 bp, Homo sapiens; identical to SEQ ID NO: 931

SEQ ID NO: 1837 - DNA, 137 bp, Homo sapiens; identical to SEQ ID NO: 932

SEQ ID NO: 1838 - DNA, 24 bp, Homo sapiens
tgaattcacacgaaggcaaaaatg

SEQ ID NO: 1839 - DNA, 25 bp, Homo sapiens
aaggaggagaaattcacgccttggc

SEQ ID NO: 1840 - DNA, 30 bp, Homo sapiens; identical to SEQ ID NO: 935

SEQ ID NO: 1841 - DNA, 416 bp, Homo sapiens; identical to SEQ ID NO: 936

SEQ ID NO: 1842 - DNA, 31 bp, Homo sapiens; identical to SEQ ID NO: 937

SEQ ID NO: 1843 - DNA, 52 bp, Homo sapiens; identical to SEQ ID NO: 938

SEQ ID NO: 1844 - DNA, 23 bp, Homo sapiens
ccgatccctccacttcccctctg

SEQ ID NO: 1845 - DNA, 780 bp, Homo sapiens; identical to SEQ ID NO: 940

SEQ ID NO: 1846 - DNA, 86 bp, Homo sapiens; identical to SEQ ID NO: 941

SEQ ID NO: 1847 - DNA, 633 bp, Homo sapiens; identical to SEQ ID NO: 942

SEQ ID NO: 1848 - DNA, 508 bp, Homo sapiens; identical to SEQ ID NO: 943

SEQ ID NO: 1849 - DNA, 579 bp, Homo sapiens; identical to SEQ ID NO: 944

SEQ ID NO: 1850 - DNA, 260 bp, Homo sapiens; identical to SEQ ID NO: 945

SEQ ID NO: 1851 - DNA, 63 bp, Homo sapiens; identical to SEQ ID NO: 946

SEQ ID NO: 1852 - DNA, 56 bp, Homo sapiens; identical to SEQ ID NO: 947

SEQ ID NO: 1853 - DNA, 22 bp, Homo sapiens
ttatttattttcatttttgttg

SEQ ID NO: 1854 - DNA, 251 bp, Homo sapiens; identical to SEQ ID NO: 949

SEQ ID NO: 1855 - DNA, 662 bp, Homo sapiens; identical to SEQ ID NO: 950

SEQ ID NO: 1856 - DNA, 64 bp, Homo sapiens; identical to SEQ ID NO: 951

SEQ ID NO: 1857 - DNA, 157 bp, Homo sapiens; identical to SEQ ID NO: 952

SEQ ID NO: 1858 - DNA, 51 bp, Homo sapiens; identical to SEQ ID NO: 953

SEQ ID NO: 1859 - DNA, 52 bp, Homo sapiens; identical to SEQ ID NO: 954

SEQ ID NO: 1860 - DNA, 21 bp, Homo sapiens
gtgagccaccgcgcccaggtt

SEQ ID NO: 1861 - DNA, 262 bp, Homo sapiens; identical to SEQ ID NO: 956

SEQ ID NO: 1862 - DNA, 84 bp, Homo sapiens; identical to SEQ ID NO: 957

SEQ ID NO: 1863 - DNA, 13 bp, Homo sapiens
ttccttggtgcct

SEQ ID NO: 1864 - DNA, 25 bp, Homo sapiens
attctggctctggaagacctcggtt

SEQ ID NO: 1865 - DNA, 37 bp, Homo sapiens; identical to SEQ ID NO: 959

SEQ ID NO: 1866 - DNA, 65 bp, Homo sapiens; identical to SEQ ID NO: 960

SEQ ID NO: 1867 - DNA, 27 bp, Homo sapiens
tgtgtaggattgcagctccccagtggc

SEQ ID NO: 1868 - DNA, 286 bp, Homo sapiens; identical to SEQ ID NO: 962

SEQ ID NO: 1869 - DNA, 87 bp, Homo sapiens; identical to SEQ ID NO: 963

SEQ ID NO: 1870 - DNA, 762 bp, Homo sapiens; identical to SEQ ID NO: 964

SEQ ID NO: 1871 - DNA, 993 bp, Homo sapiens; identical to SEQ ID NO: 965

SEQ ID NO: 1872 - DNA, 778 bp, Homo sapiens; identical to SEQ ID NO: 966

SEQ ID NO: 1873 - DNA, 382 bp, Homo sapiens; identical to SEQ ID NO: 967

SEQ ID NO: 1874 - DNA, 467 bp, Homo sapiens; identical to SEQ ID NO: 968

SEQ ID NO: 1875 - DNA, 410 bp, Homo sapiens; identical to SEQ ID NO: 969

SEQ ID NO: 1876 - DNA, 139 bp, Homo sapiens; identical to SEQ ID NO: 970

SEQ ID NO: 1877 - DNA, 39 bp, Homo sapiens; identical to SEQ ID NO: 971

SEQ ID NO: 1878 - DNA, 74 bp, Homo sapiens; identical to SEQ ID NO: 972

SEQ ID NO: 1879 - DNA, 403 bp, Homo sapiens; identical to SEQ ID NO: 973

SEQ ID NO: 1880 - DNA, 552 bp, Homo sapiens; identical to SEQ ID NO: 974

SEQ ID NO: 1881 - DNA, 517 bp, Homo sapiens
tatcctctctttttaacagtcccaagtccctctctcagcactctacccaagcgccagatttctaccttaaacgccctgattcttggggaaatcgggagccccctacaagtccctggggcccaccaatgcccttcctgggcctgggaacagaatgcctgaccctgcttccctctctccccagccctcacagaggatgattcaggcgaggcgtcatctcaggtatggacccctaagcagtgaaggagcccctcctccctgcatccacactaacttctcccctgccccaagctctgtgagaagagaaggaagttagacctgggaaaacctgtttggaaagaatgctaccttcagggtatgctgccaccaagtggcggcagtgtgctcagcctaactcccagaactgggtgagaatactggatggggccaaattatggggctggggtgggagagtgagtcctttgctctaattgcatcgatagttccccgttctcttgaggatagaacctgaacatctaag

SEQ ID NO: 1882 - DNA, 405 bp, Homo sapiens; identical to SEQ ID NO: 878

SEQ ID NO: 1883 - DNA, 68 bp, Homo sapiens; identical to SEQ ID NO: 879

SEQ ID NO: 1884 - DNA, 948 bp, Homo sapiens; identical to SEQ ID NO: 880

SEQ ID NO: 1885 - DNA, 489 bp, Homo sapiens; identical to SEQ ID NO: 881

SEQ ID NO: 1886 - DNA, 862 bp, Homo sapiens; identical to SEQ ID NO: 882

SEQ ID NO: 1887 - DNA, 606 bp, Homo sapiens; identical to SEQ ID NO: 883

SEQ ID NO: 1888 - DNA, 141 bp, Homo sapiens; identical to SEQ ID NO: 884

SEQ ID NO: 1889 - DNA, 43 bp, Homo sapiens; identical to SEQ ID NO: 885

SEQ ID NO: 1890 - DNA, 309 bp, Homo sapiens; identical to SEQ ID NO: 886

SEQ ID NO: 1891 - DNA, 175 bp, Homo sapiens; identical to SEQ ID NO: 887

SEQ ID NO: 1892 - DNA, 179 bp, Homo sapiens; identical to SEQ ID NO: 888

SEQ ID NO: 1893 - DNA, 98 bp, Homo sapiens; identical to SEQ ID NO: 928

SEQ ID NO: 1894 - DNA, 450 bp, Homo sapiens; identical to SEQ ID NO: 929

SEQ ID NO: 1895 - DNA, 198 bp, Homo sapiens; identical to SEQ ID NO: 930

SEQ ID NO: 1896 - DNA, 452 bp, Homo sapiens; identical to SEQ ID NO: 931

SEQ ID NO: 1897 - DNA, 137 bp, Homo sapiens; identical to SEQ ID NO: 932

SEQ ID NO: 1898 - DNA, 24 bp, Homo sapiens
tgaattcacacgaaggcaaaaatg

SEQ ID NO: 1899 - DNA, 25 bp, Homo sapiens
aaggaggagaaattcacgccttggc

SEQ ID NO: 1900 - DNA, 30 bp, Homo sapiens; identical to SEQ ID NO: 935

SEQ ID NO: 1901 - DNA, 416 bp, Homo sapiens; identical to SEQ ID NO: 936

SEQ ID NO: 1902 - DNA, 31 bp, Homo sapiens; identical to SEQ ID NO: 937

SEQ ID NO: 1903 - DNA, 52 bp, Homo sapiens; identical to SEQ ID NO: 938

SEQ ID NO: 1904 - DNA, 23 bp, Homo sapiens
ccgatccctccacttcccctctg

SEQ ID NO: 1905 - DNA, 780 bp, Homo sapiens; identical to SEQ ID NO: 940

SEQ ID NO: 1906 - DNA, 86 bp, Homo sapiens; identical to SEQ ID NO: 941

SEQ ID NO: 1907 - DNA, 633 bp, Homo sapiens; identical to SEQ ID NO: 942

SEQ ID NO: 1908 - DNA, 508 bp, Homo sapiens; identical to SEQ ID NO: 943

SEQ ID NO: 1909 - DNA, 579 bp, Homo sapiens; identical to SEQ ID NO: 944

SEQ ID NO: 1910 - DNA, 260 bp, Homo sapiens; identical to SEQ ID NO: 945

SEQ ID NO: 1911 - DNA, 63 bp, Homo sapiens; identical to SEQ ID NO: 946

SEQ ID NO: 1912 - DNA, 56 bp, Homo sapiens; identical to SEQ ID NO: 947

SEQ ID NO: 1913 - DNA, 22 bp, Homo sapiens
ttatttattttcatttttgttg

SEQ ID NO: 1914 - DNA, 251 bp, Homo sapiens; identical to SEQ ID NO: 949

SEQ ID NO: 1915 - DNA, 662 bp, Homo sapiens; identical to SEQ ID NO: 950

SEQ ID NO: 1916 - DNA, 64 bp, Homo sapiens; identical to SEQ ID NO: 951

SEQ ID NO: 1917 - DNA, 157 bp, Homo sapiens; identical to SEQ ID NO: 952

SEQ ID NO: 1918 - DNA, 51 bp, Homo sapiens; identical to SEQ ID NO: 953

SEQ ID NO: 1919 - DNA, 52 bp, Homo sapiens; identical to SEQ ID NO: 954

SEQ ID NO: 1920 - DNA, 21 bp, Homo sapiens
gtgagccaccgcgcccaggtt

SEQ ID NO: 1921 - DNA, 262 bp, Homo sapiens; identical to SEQ ID NO: 956

SEQ ID NO: 1922 - DNA, 84 bp, Homo sapiens; identical to SEQ ID NO: 957

SEQ ID NO: 1923 - DNA, 13 bp, Homo sapiens
ttccttggtgcct

SEQ ID NO: 1924 - DNA, 25 bp, Homo sapiens
attctggctctggaagacctcggtt

SEQ ID NO: 1925 - DNA, 37 bp, Homo sapiens; identical to SEQ ID NO: 959

SEQ ID NO: 1926 - DNA, 65 bp, Homo sapiens; identical to SEQ ID NO: 960

SEQ ID NO: 1927 - DNA, 27 bp, Homo sapiens
tgtgtaggattgcagctccccagtggc

SEQ ID NO: 1928 - DNA, 286 bp, Homo sapiens; identical to SEQ ID NO: 962

SEQ ID NO: 1929 - DNA, 87 bp, Homo sapiens; identical to SEQ ID NO: 963

SEQ ID NO: 1930 - DNA, 762 bp, Homo sapiens; identical to SEQ ID NO: 964

SEQ ID NO: 1931 - DNA, 993 bp, Homo sapiens; identical to SEQ ID NO: 965

SEQ ID NO: 1932 - DNA, 778 bp, Homo sapiens; identical to SEQ ID NO: 966

SEQ ID NO: 1933 - DNA, 382 bp, Homo sapiens; identical to SEQ ID NO: 967

SEQ ID NO: 1934 - DNA, 467 bp, Homo sapiens; identical to SEQ ID NO: 968

SEQ ID NO: 1935 - DNA, 410 bp, Homo sapiens; identical to SEQ ID NO: 969

SEQ ID NO: 1936 - DNA, 139 bp, Homo sapiens; identical to SEQ ID NO: 970

SEQ ID NO: 1937 - DNA, 39 bp, Homo sapiens; identical to SEQ ID NO: 971

SEQ ID NO: 1938 - DNA, 74 bp, Homo sapiens; identical to SEQ ID NO: 972

SEQ ID NO: 1939 - DNA, 403 bp, Homo sapiens; identical to SEQ ID NO: 973

SEQ ID NO: 1940 - DNA, 552 bp, Homo sapiens; identical to SEQ ID NO: 974

SEQ ID NO: 1941 - DNA, 448 bp, Homo sapiens
tatcctctctttttaacagtcccaagtccctctctcagcactctacccaagcgccagatttctaccttaaacgccctgattcttggggaaatcgggagccccctacaagtccctggggcccaccaatgcccttcctgggcctgggaacagaatgcctgaccctgcttccctctctccccagccctcacagaggatgattcaggcgaggcgtcatctcaggtatggacccctaagcagtgaaggagcccctcctccctgcatccacactaacttctcccctgccccaagctctgtgagaagagaaggaagttagacctgggaaaacctgtttggaaagaatgctaccttcagggtatgctgccaccaagtggcggcagtgtgctcagcctaactcccagaactgggtgagaatactggatggggccaaattatggggctggggtgggag

SEQ ID NO: 1942 - DNA, 100 bp, Homo sapiens
aggcagggttagtctgatatgatttattctaacagacagaagcagaaatctgttatactcttttaattactgtgtctttataatattatggtagacagaa

SEQ ID NO: 1943 - DNA, 422 bp, Homo sapiens
aataaaatggagaaggctttggagtggggacaagaaggaaacggtgggagagggatgcctgtatgctgatatggttgatgcctgtatggttgaattgggtctaccgttcctcatctaattagctatggtctattaaggtgcatagctacacacaaatattggtactacgttcaattcagaggaataagatattgcattcttgacagtagacaagaacaccctgaatttggggtcactgtatcataagtcatgttatcaggtccctctaggaaggcttagaggaagatttccaggatacacttgtgacaacattgaaggcttcttttttccccaaagggacccgatctcccctcagtcgagaagctccaagtctctgaactggatgccaggttataaattccccctatactgactccatcagg

SEQ ID NO: 1944 - DNA, 229 bp, Homo sapiens
agtaaaagatagactcatgggagtctaggcatttattctcttattttatataaatcagttaatgtgcaggaacaaaacagactttgaagaaagacactcacagttgccacaggaaaacaccttcaacatcctcatgagtcatcatgggtgttctgttgggaggacttgataggaggctttcctcctcacgggctagtgcagatccaggggaaatgtcatcaagtcctcc

SEQ ID NO: 1945 - DNA, 21 bp, Homo sapiens
gggccctcagtttagcattct

SEQ ID NO: 1946 - DNA, 277 bp, Homo sapiens
gtgtaacgtaagttgatttcttagtagatgtcccatccattacattcccagacacctcacaatgattcgaatgattagtaaccaccacatatccctgcctctcagggaaatccctcccgccttgtctctagatggccaagtcccacggcctgtcctctactcttccagaaccctgttgttctcactgacagcagggagggcaaatccatgcagcagctcccgccatgacctccagcctgcagaggatgggcgccacaggacttttaaacgcatgccg

SEQ ID NO: 1947 - DNA, 587 bp, Homo sapiens
tgggaagaaggaggggatgttatgggaaaacaaaaggagaatactagctaagaacgctaggtgacattaatattccgaagtctgtgctcatattcagcaaagaaagttcagcataaagcactaaataaggagtcaagatattgtacttccaactgttgttccaacagctgtattatgaagggccactttatttcatgcctttctaatttgacctaaagtgccaggtggcactggggctggcacagccttgctcaattatgtgttgcagagtacacagagactgccaggctgagggaagatgcaagagaatagaagagatgctctcagggaacaagagaccacatggccccagagtcaggggcagcatcagccactgtcagctgctcattttcccagacagagcccacaagcctcagccatgctttgcttctgcaagacgcttcttcaccttttcaataaacctgcctgaatttaagctgacagggtttatttctccttcatcataaatgaaattcttcaccacaacaatctccaatgaattttgggcacagcaggcaggcccatttctgcttctgttccactatctc

SEQ ID NO: 1948 - DNA, 982 bp, Homo sapiens
attctgttattctggttcctttttggctactttgtttttggtagcgtgtatcctaaggcgtccagttgaacaacttttgtctactgtgtccaggcattcctggtggtatttcagataagactctcttgggttgctgaactcacaaccactgaaccaattctatgaccatctgtttcatggccacatgtttgctcattttatatgtacataaagggaggggacagacagcaaacttgcgtgttacaaattgtatcatcttaaaaaggaaacaaggcaacactttgcaataaaaccttaagatgcatgaaatttgagcctaatgcaataaaggatgcccataaaattcttatctaaagaatgtttcgaaaattgttgtacaaggacatcatcatttaaagtgatatgaagaaaccttctcagctaagcatatgggctagattagagagaaaaataaaggacccatctctgccctggaaaaactgctggtagcatctttcaaaaagctctctgtgtttgagtacgcaccttgatccataggctcacatttgatcccaactggcagctgcttcttggcattaacattggattcccaactagtaaatcttaccaagatctgactttctgcagatataatattattttgtttgaccatccttatcttcaagggctaccaagaaggaaccaagaatttatttacctccccaagggaaaaggttttaccaatgagaccctttctcaccatgaccccaggaccccatatgccctgttcacttgagtgccctgtgtggcctgatagaagctcatgctggtcacaggattccttatatgactagcctccttcctgaatcccaatttcatggtggtggtcatgacaggtgtcctgtatcccatgctcatgtccctgaagtcaccagcctatctccagttagaaaaaattacatgtatatagagaggcctctttggaaggagcaaaagctttctc

SEQ ID NO: 1949 - DNA, 136 bp, Homo sapiens
tcgtacactaatggttggaaggtacaacagcatatgcactttgggaaaaaatatctggcatattcttacagaaacaaacaactacctattctatgactcagtaattcctaagcatttatccaagagaaactaaaac

SEQ ID NO: 1950 - DNA, 85 bp, Homo sapiens
gtgagaaaaaaagataaataataatggttccaagaaatgcacagcagacagcccagaggcaaagacccacaggacggcgggccgg

SEQ ID NO: 1951 - DNA, 430 bp, Homo sapiens
ttaggatgcagcagccccatatcaaggttttggtggcatcctgtaattgtgtggttagtacttggcattgaagtgcaccaacctggagtcagagcagttggagatttcaaggcctgtgccatttacctctaaccctggggtgcccctggaatacagatagcagatcggttaaggagaagcagcctcagcaatctagacagtgcaggtttctggtgaggacaggtaaaaaccatctgggtgggcagaacttggtgaagaccagaaaccactgagactcagcagctgccgcagtggcacccacaaatcaaaggagggggctgggaagagctaagggctactggatgagctctctgcctgcaagacagaagcagatccagagattttggaaaataatgtaggtttcagtacagtgtgatctcttcaaaaaagt

SEQ ID NO: 1952 - DNA, 1090 bp, Homo sapiens
ggaaggaaggaaggaaggaaatgaacaaatttacatgaagatgagaacagtggggaaacttacaccaccaatattttccattaacaggaacacgctaagtagttattagagaaagacacgctactgtaaaacaatatactgtttccatggggtacaacaaccccttcctcctcctctgaaacacattctatctctggctcactgttgccagagacactgagtcttgtctttggatacgttctggtgcccacaagaatgagatgagacagtggatcccagaacaccaggccacgaacttccctgttgctccttgtccactccagaagctacccagctgcagttggggacctcagcccctgggtctgatgtcatccatttgcctttctcaatggacttctctccttgcactggctcctactcccccaggacctgtgggtgaccacatgagaagaacacaaacaggccatgcccctttctttctccccctctcaatgcctgcagtagtgggttccatggggtagtgacctgagatttactcattgtggggcctctagcccagagcagggcctactacctcacagtcaccccatgaatgctcagtgaaagaagacgtccaccacaaggtcctggggaaccaagaattccactgtggcccataaattctaagtctacaggattctggaatgggagatgggaaaggccttcaaaagtggccacttttaacccattatactggcaactgagccatgtttccccatcctggacacatccagagggcactgcctaaaaccagacacatctccccacccaggacagtgtaggagccttagcctgggggatgcaggtggacagggagggggtgagccaccaaagctgaagagcagaaagcaggtgaaaggggacagcagggtggaaacagagagaaatgggggcagagaatggggggtgagaggggaagagtgaggagagggatgcagatctagctagtaaggaaaagtcctggagagaacactgtcctctcctgaagtaaaatcacttctacctgaccacggcactgcagctcatgggcagcacatgctgtggatatttg

SEQ ID NO: 1953 - DNA, 356 bp, Homo sapiens
aggccctgcaatgtttagggaccttgacatcttcccttcacatctgagtcataatacaaagaggactctctgaccccactgagctggcaatgcctcgggatttttacctgttggatctggcagctcttgatgtcagcccacaccatgtgaggctgctcttggtgcacccaatggggaagtttctacatcagggcctcggagaatccactggaagccctggacagtgggagtcagcggcatccccagtgtggaggccaagagcacacagtgcttaagctccaggcaccctcaggaggacggcaagggacaattggctggtgagagcccgggtcaccgggaaccttcgcctgggtcta

SEQ ID NO: 1954 - DNA, 51 bp, Homo sapiens
tggtgggaactagaggtggttgggtttctgtcatatgtaatcaacagtcct

SEQ ID NO: 1955 - DNA, 280 bp, Homo sapiens
gggaaaaaaataaagagtcctgactaaatactagagtagccagggaagttttcacaaagtaagtaatatttgaggcagatcttagtgaacaagaattccattatttctgttagggaattaagagagtgtgggtgtcgttagttaatgcttattaaagtagctttggaatctcatctactggtctagctggtctatctgtacacgtatattgtatatgctgtctctctgagctttcgctaggttatgctacggtaacaaaagccccaaaatcttagcagct

SEQ ID NO: 1956 - DNA, 307 bp, Homo sapiens
tacaagctactttatttgttagatggtgaaaactgtgatactcggaggttgttgaatatggtattagtatgttcattcattcattcatttaagaaatatttattcaatatctgtttcatgccaggcaaggtcaagtactgagaatacactggtgaatcaaagagacaaaatctctaattgccaggagcttatattgaaaatcagattaaacacatacaaaatcatcataataacaacaatgaatactatattcataaataatagctgtaagagattttagtacatcttttaaattagaaaaatataa

SEQ ID NO: 1957 - DNA, 310 bp, Homo sapiens
ttatttgatgtagtcctaaaactattatgtagaatactattgtttatatcacagcacgtgagccccttaaatggcttaacacttatttaggtatgatccataaagcttttctggtaattaagtatacttaagaacaattaagtataaaagagttactgccttgacaggaagattgtaaaaattttaaaaagacaaataaataaaagagtaaaaactgtagctctgtgaggctcaaataacatctaattcaagtcacaatgaacatctagcaatcattctgaacaccatataattcacttaatacgttttg

SEQ ID NO: 1958 - DNA, 1531 bp, Homo sapiens
gggagagagagacagaggagaaagtgagctcagcgaattggccgggtgacacactgacgaaggggtcaaaggacactctgagttagtgccctcgggacacacagagaacagtgatcatgaaaagagtgggctcaataattttccataaacttgcttaagattccatgcagttgccatacagcctttgaggtatggtcaacctacagtaagttagtaaatgataaggggaggaagaaatggaaacctaaacatctactgcaaggaaaaccaacagcaatgtcagtaggagtaattcaaccttcgttgaaaacatgaaattgaacatactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacgcagggacttcaggctcctcagcatgagaataggacactgtgagagatcttcttcaggaggcctgaaggctgatcatgatagagattcctgggtttttgtcccagaaactgtgggtaaaattccctattctggtagatcgttatcccaagatcatttgtcccaagtttgtgcaaatggttatgccatatttttccaatcgatttaaagcaaatgcccccaaatggttgctgggagaaaaactgcaatattcagccctgtctcatcaaatactcagattcttcatggtagcgaggattttagatgctgaaattagagtgaaggatgaaatctacaagatctacaaaattgagacaaaatcagagttgtgtgaatttgtcacatctgcccagatccaacatcttgagagtgggattagggtgccacaggcatggcctgagactaggaagagagccctgctcactgacccatcccttgcctgggcttccaagtggaactagagtttcattcaacctacatgtgcctataggtcctccctgtggcaatgacatctctcagctcagtaagggccatttgcagtaggaatatgaccctaaccagaagactcagtggatccttatcaccttcatagaaaggtactcaccatccatgtcaagagcccagccaacacgctgttgctccaatatgtaaaaggcacttctgtagggctggcatgagtcagtcagttcaagataacctgaaggagttgaataacatctatccagtgagtcctgcaagacttcaggccctttctcatccagcagctccctgctgagcctggaacagtgggaaaaagtaaagaataagccagggggaatcagaaaccacacagccccagctagatttcatggctaacataaggaagagtttgaaaagaaaaaggacagatccattaatgaggtaacaaattattgcctttatattgggatagactagggccaggtagaaaaggatgaaagagaaag

SEQ ID NO: 1959 - DNA, 2217 bp, Homo sapiens
gagtgagctcagtgaattggccaggtgacacactgatgagggagtcaacggtcattctctatttgtgctctcaggacacacagtgaacagtgatcatgaaaagcatggcctcaataattttgcataaaatgtgctcaagtttccctgcagccaccatgagaatacagcttttgaggtatggtcaaccttcactaggttagtaaatgataagggtaggaagaaatggaaacctaaacatttactctaatgagaaccaaaaagcaatgtagtaggcataatttagacttgtctgacaagacaaaatcattattttcagcatgtactgttttccctggacttggcatctccaggtgtcaacatcaaattaactgtccacaatttctcagactcacctgggacctgttgcctcttggtcctcctttttcacttgatcccaccgatgtcctgcaaataaattcagatggggcctcttacattaagcagttcttccttgcacacagaaacattcctctgtccaatcctaacacaggtacatcagtctggtcagtgtgagaacaggagactttgagagaaatattccagcaggcctgaggtcaagtcttgagaaaactggcttgggttctttcatgagccttgggcaaaattaccctgttttggaatgttatcttccctatgtgctctgtcctaggtttgtgtacacaaatgagcaactttttccccaataaattgtaggcaaatagttctaacacctcataggagagatacttcaatattaagctttctctcatcaaatacccagaatttgatagtttatgagattgtggacacagagatttgatgaaggggtgcaatgtaccagctcttgagtcaaaatgaaacttggttctacacagaagcatcagctattatggcttttgtgggtgaaaagtcagccatttatctagaaaacataccaggaacatgacggacagatgagctaaagcaagcgaacttagaagacacagaaaatgggaataaattcagtgaaacctgggccacatctttcactgagaggtagacaagggtgacacttgccttgggcaggtaaagaaccacacagacatgctttgggaacaaaactcataaggaattttgtagctggcaagagacatttaattcagatgagctgatctgacagacaactcctggtcatgtgctgcatagtttggtgtgagcttgccacacctgccttgagttcaatgtcgtgacagtcagtccaggttggcacgggcatggcctgagactaggaagagagcaaagctcactcacccaccccatgcctgtgcttcagactcgactccagagtgattgaaatctacattgatatataggttcagcccacagtgatggcaaatctcagcccaacaaggggcacaaggcccaaagattatggggtctacctgggccatgaactggagctttatcaccttcacaatggagtactcaccgcctatgtcaacagccatgcagacttgctgttcctctaatgagtgaaatgtgccgctgtaagacttgtacgaggccaacatttcaggaggaattgagagagtcgaataaccttcatcccaggactcctgggggacttcctcctcttcagactcctgcagattcctgatgagccaggcaggacagggatgatagaagatttaaccaacagacattagacaacaaaacctcccagatgatctgatgggagacagaatggagtggtcacagaaaccaaaggcatttttccttcaagagaaataaaactagccttctaaatacagggtggagggtgactgctctggggacagagcaaaaatgggcagcatgtgctcagtacatttgccacagatgagccaactcagggcacccagactctccctgtaaactaccatcatgacttgcagcacagagaactgacacagggcttcaactactttgcataaattgggttgaattttacatgcagcattcaagtgaagagagttcttgacacagtgcagacacagatcttgtgtattaagggccccattttcccaatattttgatataatatatttaccttttcaatttcttttcttgcaaaaatactagccaacatactaccaacagataggaagaaagcatatatacatctctccctggatttaaacacatgggagagaataggcaacaccaagaaatccctgtttg

SEQ ID NO: 1960 - DNA, 714 bp, Homo sapiens
aaaccctgtttggctagttcacctggctcatctgatggcaagttcctatcttgagaggactatgaaattaaaaccaatacaagtgccacaaataacatacaacattgtaaatcagcacaatttgtagctgggtgaatggaagaaatagttctattcatcacttcctcattttccctaaatctacaatctccagatgtcactactgaattaacagccaacaattccacaacattacctgggagacactggccctttttcttcctcttcctcatcatcactttcattttctgtaaataaattcagagaagcaggtcacattaagcaattcatacttcacatatgaccaaatcactgtccagtcatagcacaaggacataactattctcagtgcaagaataaggattctgacaggaatattctagggtgccctagattaactttggtgagaattagatgaccctgctttccagacccacaggccaaaatctccctctacgtgtagaccataatgccatattccctgcctgagtcaaagttaaacaaaattttttccccaaaaaaatctccaaaaattggtccattttctaagagtgttgctgcaatacggacttatatcaccagataacatggacattaaatgtttagaggcatctatacatgaaacacacatgatagataaatttgaacaactcttgctttaaaaagaatctgtga

SEQ ID NO: 1961 - DNA, 1308 bp, Homo sapiens
aatccacgatgctacaaagaaacattggatcagccattgcattgacagggtggagaaccagggtccagccttgctttatggaaatatatcagcaaagtaaagaagaaaagtttccgtcctgatttcagggtgactgtgcagctaagcaagctgacttaaaggagatccggatgaaagctgagagcagtgaagcctggggaacaatatttccaaatacaaaggcaaggctgccagcttcctgaaacaggcatagaaactccatggacattgttcagggacagatgacttaatcacagatgacaagagatactgaatcgaagctaggaggcctgacagatactgcctgtgcacctcctgcactcaggtgactatgagattgtcacacttgcctggggtcgagtaacttgatactggggactggcagacaaaggcatgacattagctgagaaggacaaaaaaactccctgatatctgtttagaaacccatcatagttttttattcaaatgaatttgtgtttatagagcctgtcttcagagtttatcttcctcagcctagagagaggtatgagacacaaggaaaacagaggctacctgggataatgtgtacagcatcctcccattcaacatgagaggatgagccaatgagagttgagtcgactttgtcttcctcaaatgtgattttggttttcctatgtggctggttggagtcataagggccatggctatttgaacaagtgatggcacattcctccagtgagtcctcagggacttccttttcttcagccttcggcatctccctgatgagccaggtgggacagagatgacagaagattaaacacagagggattggaccccagggagtcctagctggttttgacaggcggcattaagagagtggtcccagaaagcaaaatggaggttccctttaagggggaacatgcaatcctgttctctctgcaacagagcatggctgccatgggaaccagagaggaagagagcagctggtgttcattgcagtggacagataggagctgaggaggatgaagactcagctatccctgtatggtgcagacatgacactcggcacacatagagaaacatgacagctgccgcaccctgtgtctaagctgggttatatttcacatactgtggccaagcaaatgcgggtttttggcccatcatagatgccagagagggtgtacctcctagatattcttcatatgttaccatccattacttgttcctgagtattcagtgttacctgggggcagacgatttctgcactttctcagccacctcaacttgaac

SEQ ID NO: 1962 - DNA, 1111 bp, Homo sapiens
ttgtggtagtgtgtggttgtaacttattgagagattataacctgtcagctgctgtgctcggcaggttcttcatcatcatcatcatcatcattatcatcatcatcatcagtcccaggcaatgtttattaactggttatctggaaatgtactctatatgtgccatccatttaaaatcccacaaacagaagttcaaaaaggctcataactagtgagaagtggaccctaaattcaaatccagacctatctattataatttagcagctctgaaatagtgcataataggttttaaaattcaatacatttcacagtcttcccaaatagtccgttttcaaaactgaacacacaatctaatatattctgtacctattatctgatggctgtatctgtttgaaccgactctctggatatacaagttacctcttaagagcatcttcacatataacaattttcaagttttcaaagcttttcctaattgattagagacagaagaagagttcacatcacactaccgcatcagctccagccccattcccctccctcttcctcattcttacctctttcctgtgacactgaaagttcccaccccttatcgttgaatgaggaatactctacacatcagggaatttctttggggactgaactttggagactgtaccgaagtcccaagtgggtttatgaaagaattttttagagaaaatttattgttctccctggaggaaattgtggtaaatataattttctttatctctcctgttaaattaacttgaaattattcaaaaagtaatggcattgtagttactgagagtaggcagagaacccatgtattcttttctcaaaacccatgtatttttaagccatggtggctaagaaattcttcccacgtaatctgattaaaggcttaccacgtacacagtttttctgttaagggtagttgaagaaagcaagagaatggaaggattgaagaagcagtgcttgtgagaggttaactgtgcattgaaaatggctagtgactgaagacttaggaatgcaccacatggtcaggtagagaataagaaagaagttgatcatttgctatttttaccccttggttgttgttttttgttttgttttg

SEQ ID NO: 1963 - DNA, 1140 bp, Homo sapiens
tacaccttggttttgatacagaagtgcattgaaggattagagaagcaatcttcccaaatgattccacaagtgtcttagaatgtaagagatgggattctagagggtctggagaaagactgaatggtggggaagatgaacaaaatatcttgaaatttggttccagcttctagtctgaattgaagctctttttctaagagcgtatctgaaatagaagtgtaaagggaaaaaagctcaattagtacaagattcattccaagttgagctagaagtgaaagaacagaaagctaaaagcatcccatatctcaaatagtcctgaaaagtgtactcaattttggccatagacacggaatcgagcacatctgtcatttcccattgttgtgaatgtcttaaggttacccaaacaaatggtcaaagaatatagaaaaatcataccagtttagcagagtctgaaaagtctacctcagatttggaaagcagcacaatgttgtcaggggaaattcgttattattagatttaaacattgcacatgatcattatatcaaaagacaaggcattcagtaaaactttataaatctcatgaaatgcttgttgcgagcagatactttgtggaaacaagtgaaggaacaaaatcacggcagagtaccagagacagacagaggtgtctaggtaggtggagaggaagcgtaaattcagttgcctacattactgacaaaaggactgctttggcaaaatgtaaaagtatatcttattattgctttctttggttcaatcatgaaggaaaagtgtaccatcttagcaattaaaataagtatgccaatttttctctgaattcttttacaacaagtgccctagcaattacttcctcttttctttatatctcaaatttctatgggttttacttctgctagctacgaacatggtctggagaatttttcttctgtcatcctactctatcaagctactttcctcccatagccatctctcttcctttcattatcaccatacttcccaaataaggactcattgctttctctactacagtacccatccatccctttgccattttttgactgttatataccaatgatgcttttcttttaaatggtaatactaccctggtattagccaagtttaatggcc

SEQ ID NO: 1964 - DNA, 33 bp, Homo sapiens
taagactactttgaataacagcaacagtatctc

SEQ ID NO: 1965 - DNA, 157 bp, Homo sapiens
atcatttccttcttattttgttaatattttcttcctaattacaagtaatttcctcaaatagcaagaatgatgcgctttatttcatttacaccctccacaacattatccagggctggtcacaaaattaaaataatcattataatgacaataataatac

SEQ ID NO: 1966 - DNA, 1092 bp, Homo sapiens
ggataataaaattgtactttgtgtaagttatttctcaattatcattatagtaaaagcaaacatatgcatttgtatttatttccatatcgatgagtttcatgctcagaattttacttttaaagaaaggctgtattggaggagtgggaagacaagtcagagaaagctttttagggtttccatccctaaaacctcagctcttttaaaaatagactatcacttctccctctttcctaggtgccttttgagaaacaattaaattattggactacaacatccaaagtgtctcagaaaataaaagtgccttatgagtgtgataatgttaaattcacctaataaggcaacctaaaataattactgctaaaatatgtacttgataatttctacttacactagattcaaaaccctttaagcatttttactatataaaaagtatatccattttgtttaaataactacagtaataccagattcttttaagaaaatccttctcaaattttttttaatttaactgactgtagaacaaggcttgagtaataatcagattaactgtgcaaaatggcattttggccttctgtatttaaaaaaaaaaggaaaacttatttcaaactccaataatgcctctagcctacacatttgaattctatgttgtttcaatgaatatataagcaattaaacatagaaaatgtatttttagagaaacagcaactttatatacctaatgtgggcacagtctgaattgtctttgacacagagatagaccaaatgacttgatatgttttagaagagaacaagaggtagatgatcaactgtatgtagataaatactaaatatacgttgatatatttcaggttataatggtaccctctaccctttccctccttcatttggccactgagggaaacataataactgctgataatgaaagtcttatccatggtgaaaagtcctatctttactgtacattggggactagcttttatattgcttggataactctaaacctttaaactgctatttctagggcaaattctgccctccaaaacttaattgggcagaatcctatgttgactcagagggaataaaatgctctca

SEQ ID NO: 1967 - DNA, 227 bp, Homo sapiens
tttgtaggagctactgactgagcagtttactcctagggagaatgtaactcaccctggttccctgcagaaacagcctcctgttataatcaggattattatcctctgtttactccctttctctgcctgagtctctcagtaacagctgggggcctcatttataaacaacctgtgctataaaatgcccatgatatacacagtatgaaaacataggaacatggtttatcctt

SEQ ID NO: 1968 - DNA, 458 bp, Homo sapiens
gttttatatgtattcagtgcattttctccagagagctgaaggcatttcataaactttaaataaccagtaggtataaatctatgccactgtaagttatagttatttaatagtaataaaacaacttgagggtgaagaattggtattatttatttataattagcacatgagaaggaaaggacgtttcaataatcatagaaaaatgctaatgtaaatttttcccctgattttgttttttactatggaattgactaagtttatgagttcaagactttcattgcctagagtacgacagtctgcttataaagtatactcaataaatattattgaatgaccactgaaattatattttaattgcagaaaattatataaaatgtgttgaaattaacctcaattgctatagcctagttatttatagatttccaagcttaggagtacaaccttttcttgaatattttggc

SEQ ID NO: 1969 - DNA, 114 bp, Homo sapiens
ctctaatttcttgcttctggtgaatttacaatttcggataggtcttagtttctgagcttactgaatcattttccaggtgcattgactctacccctcactagagacaactcttac

SEQ ID NO: 1970 - DNA, 489 bp, Homo sapiens
catgcctttattccctccctccagtcctccaaaattataaccaaagaacactccagatttcgcgaagtttgggccatgctgcttgtggatagggacagtaaaaaagcactgttcaggtgaagtttaaaatcttgatccgctgtaactgtacctccactggaaatttctaacagaccatgtccgtcctcacctggcccaggttctaggcattagattactgccatttttcaaggtatctctttccaactctgggctcttctttttcctacttttcagccaacttacatccactgaatttctatttatttcttgaatataacaatttaagtcttgtttgtttaaactctctgatctaagctaggaccaaggaaatgtatcttttataagtaagtatatacagtaggtaaaaggttttgccctgtcctcttcccatcccaatcaaagaaacatttttatctgagaagaattcaacttttcttctgtaaagtg

SEQ ID NO: 1971 - DNA, 1022 bp, Homo sapiens
gtgttttaccacccacatggcaaatattttcttataatcttttaagggaaaagtctttgaagacatataacaatgtatatattcatatatattcactcacatgtgtgtaatggagtaatatgtttaactgattttacaatgcagatgatgtgtacaccttaaacttaaccaattctaataatgtaaaacactcctttgattgcattggttactttgattacttggtctttctcacctctgaaacaccctacctccaaacaagagttcattttgaagatgatgtttgggtgtttgtaacctcatgatacaggtgaaaatgttcttggataagatgtttgcaagtctttttagtttttcacaggtggcccctctccacccatgcactgcttactagccagaaattgtgtctgtaattgttggctggactgatctaaagtagtcatctctctcagcttggttgaagcccagtggtcctccatggctgtcttcacctgatttggggttatttcaggccatcggtggttttttgctgtgcacacggttcagcccctgcctagattgattgccctgtagcctcactgaagaaccactacatcccttttatatgtcccctctggcaagcactacagacagattctcccatacttctgtgtgccttctatgaacacagaaaacaagaatgcctcttgaagttaaaaagcatatttgtgtgatgttgacttcaagctggctgcttcctggatccccaactggggagtcaggacaagaactccccactcttctccccacattgagttaccagcatctttttgtccctctttgatctttttctcccaacccctcccccaccaatacattcactttgaactgaagtccttggagaggattaggaatcacacacctgaccacacccttctcctattgctacttaagattgaaagttccttgttcttgctgccttaggtggtattggcatcttctctacacattgggagaagctctccaggtgtaaactgtgattg

SEQ ID NO: 1972 - DNA, 20 bp, Homo sapiens
tgtgattttttttatgacaa

SEQ ID NO: 1973 - DNA, 474 bp, Homo sapiens
acctctaccacatcatctcccccacctccatctcctgtatagacagatgagccttaagaacaacaattactatatactgaagctcagatgttaatcaggtaatcctagtcttaaatgtctgtgcattttttcctcctagatttgagaaaataaaaggcacaagaaatcctggcctgaatggtcatcagaacttcttgtgtgttgcttccaaaattttagaagcacttttgagcagactgcttataaaacatggctactttctagattcagctgtcaaccacagaattttctaccactaaggacagtatcagttcctaaaatcatagaagtgatggtgtctaattgcccagagaaagaattaaaagttaatgtgggtttggggattttttggtgtgtgtgtggccaaatcagcagttgttcataacataaaagtttcatgatggtacatgtggtactacttttttttaacgattg

SEQ ID NO: 1974 - DNA, 867 bp, Homo sapiens
gctcatagagttttacagcaactttatagaaatataccttttaggtataaaactacattcaaaaaacattcttcagttgattagaacaaattctcataaatcttctgattccatttatgaatttcccacatgaaagagccaaaaaagagaatgtctgctctgctaaaattctctggaacatcctctcagtactcagtggaagatggatgagatccttctgcagcagatgatgaacaataattataagtaaatggtagtgtattttagaggacacacatttaggaaatatttgaaataagaagtagggaaaggagggacttctgaacaaataaaaaatgatctagaaagcaaacctgcaatccagcatgggaatttttatacaggcaaactaaaaaatagggccattgaggttttttaaaatacaagagggagcaaggaataacaacaatcttatgccagtgaggtattatcttgaatggaaaaaagcaattgtgataaataaattattagttaaagatatgaaacaataatagggtcagctgtagaacacgttaaaattcagaaatctatagaatgatcctttacatgtattctgcttctgttgagttcagatcaaaatctacagccttcattaaattaatgtcttatttttaaaatattctccatggcaccatggagaattaaattaggcattaaattaatgccttatttttaaaatattctccatggtgcctgaataagacagaggagtaagtctaaattgggcccttatgccatacatatttatttcattaaagtaggagaatctgaaataaaatttaaattacaaatatggaagtggctttagattttcattttggttttggc

SEQ ID NO: 1975 - DNA, 127 bp, Homo sapiens
tttttctttttcttttttttttttgttctactgataattcaatcaaatgcaaactattaatatgaataaaatatattgagggtagttatgtttttgctcatctacttgctcattcattcaaaacaat

SEQ ID NO: 1976 - DNA, 988 bp, Homo sapiens
tggcaaaaactcctgcttattcctcaagcccctatgaattcctcaaacattaatgcttcttggtgaagcatttccctacctctcccccagcatggctgctcacaccttccttttggcccctactttacttggtattctccctccctctattacaacacctttcattctgtatagcaaatctccatttatgggtgtctctccttcaacccactttgagttccttttcttcccttaattttcatgactttcactcccatccccacctccactactcacacccagaactacattttgaatcttgacattgctcacaatacttccaccttcaaaaacacaggctccagtttcctctcatacatttggtctcaccacatttgctcttcttggtgacatcaccagaccctggtattttcctcccaggtatcaacgtcctctcagcttctcttccttttcgcctgaattccatagctgatcacctacggcagcagtcctgattcctttgtatccccagtcctcccatcaaatttgtccaacaaactagctctggagaaaagctcccattttcgggctttacttctactttgttagctgcactcagctagggaaaaatcacactgctgtgtgatctaacatgcagattcaaggtctccagccttgctgaggcctttggtgcctccaatcacggttttattagtgtttccatgaccttttccaccacaacgctaaaactttacagctctcctcagcctccatatttaaagcccaccctctccctatcattagattgtattgcctcttaccacataaaaataactggagcctttaagcactgttcttcttcaatttcctacctctacctacaagctcctcacactcatcttagccttttccctctagttcaagctcaaatctcactcatgcctctcctaaatcttcaagatctaattgtattggctctttctcctcagcccagaaatttattcaattc

SEQ ID NO: 1977 - DNA, 239 bp, Homo sapiens
agacttgctactttatcctacccttccttcttaggagacagtgcgtactctccttttaaccaacttttgtaacaatgcggactctcattcttgtcttcagccttcagtctcttttagatttcaggctccatatggaactctctaggggacaacacagccaacagatgctcaaactcaacacactgacaaactcatctccatgcaccacacctctgtcctcctctcgtattctctcaagc

SEQ ID NO: 1978 - DNA, 71 bp, Homo sapiens
gacaatttgatacaaattgtctatgcttctcattttcccctctacttcaggaatttcagagactgcttgat

SEQ ID NO: 1979 - DNA, 112 bp, Homo sapiens
caagcaaccccactctcctcccctggctgggttatctttaccctgctcctaactcacagggcacatcgccatcactgcattcatcttgcactgtggtcatctatttaatggt

SEQ ID NO: 1980 - DNA, 564 bp, Homo sapiens
tgaaggtctactgccataattacactctaggtcctcagtaatgcgcagtgtgtgtctgctaatggtcacaatatcctgaagggccttactgcatgcagcacaggcatgtgtggattagtgcctctttccactggaggaggaagcactgggatggaaggtcagccatgggactcttggcgacctggcccaacgagcatgtctcccagggggagccagatacactcattcacccaatcaaaaacatttactgaatttccaccaggtgccagtcactttgctattatggtccctgccctctgggaattctcaactgaggagggggagagataccttttcacaatatggggattggaagagtgatgtgatgactactgcagtcttaaaaataaaccaggagtgtgtggatatctctaagattttaatccgtaatgaaacaacaaaagaacagtaggaaaaacgcttgccaggagtcagactacccagccaatcacaaataagacctaaacccccaggtgtctattgtgaggactgaatgaggcacccatagcacccattacaggcctg

SEQ ID NO: 1981 - DNA, 53 bp, Homo sapiens
taatattcctgtttttaaaattatttttctctgttgttaggttgtttggcgtc

SEQ ID NO: 1982 - DNA, 45 bp, Homo sapiens
ttccttatctcatcctactcttgtttgaaattttccataatagag

SEQ ID NO: 1983 - DNA, 283 bp, Homo sapiens
actagtgagatttaaggctagaagctaaggctgctgccataccattaagatttaaaaaagaaaataggaaggagaagaactattgataaagatgtattcctttcaggctccccataataataaagcaaatatggacaatcaggatggcgaagaggtggaacttccccagatagctcagtttaaatactttcttatcaatgacctccaagtattcctcaggcagtcatacccttccagaacagcagggtctgcagagatcatctcactgcccagattctgaatg

SEQ ID NO: 1984 - DNA, 64 bp, Homo sapiens
tgaatcactagtgtctgatacagtgggtactaaatgttcactgaattaataaagaaatggagaa

SEQ ID NO: 1985 - DNA, 124 bp, Homo sapiens
cggagaagaggatttaataatttcttttgttttgatttttaaagaatttctggtaagagagaatctaacatctgctccaaaggtctaccaagaagttctaaaatcctgatattctccaaaactc

SEQ ID NO: 1986 - DNA, 46 bp, Homo sapiens
aagcattttactgtatgcaaatttaaacaagttttaaaagacactg

SEQ ID NO: 1987 - DNA, 1295 bp, Homo sapiens
aaaacagcattaagaaaaaaaattattctgggtccatattagaaactaaacattcccttactcaattatagagatgcaggtactcgctctttttagtggtaatataaggctgtcccaaaacattctgtttattgtccaggtcatagtgctgctagatcctaaaatgaggctatggtctttgaatttaaaatggaagaaaatcacaatatgtacatacagtcttgcattttatctgtttgtacatacatatgattatttaatcaattaatgcataggcaagttccaaacacacatattaatggagaagcaacacaaataatcagcaaagacagataatttttacaaagcacactttcatttgcctttgtaatataatacggggttttgttttgcagcagatatattcttagggatgttgggctttgactaacattaaaatgaatggtcatttttttcctattttatactagagcaagagctaaggagttcacagcaaggataaattacaatgctgatatcgataaagcaactgcattaaatgtaggcattgagaatttaaaagcattcatttgaattcaaaagccagcaaaatgttatatacttccaggtaaatgtctgtccatgtgctccccacccactcttccaagctgccccaaagagcttttctggatatctaaatgtgaaatgtgtaatagcctgtgcacacatcagaaaaggtggagaaagcaaaagatttaatgttgagattctgtcagtaaattctcagcaattacagtctctgacatgccagttgctctgtaggaagatgggaaagagagtgatgtgatggggtacacagtacaggctgaagagaagaacacagagatttcaggccaagtggatccttggccaacagaacctgtccttagatgctttcaggtgggcactatagacatgcatccttccaatcctaaagcctttatcaagtatgtgtcaagtatttgaggatggcaaatgctgaacaccaaaaaagaaagcagaatcacaggcatgtccttgccctgtaatgctcctgaatcaaaaaagagacaatgacaaggatatatttaaaatcaaaataataaccatcaaggatgtaaatttcattatcacctcaaatggatccaatattaagtcctgattaggtggtcatgtaatgagagcattaacaagaccaccctctggaagttttcagtccaagacagtaatgatggtgtttcataaaaggaaatcgtttaaataaatggaatcaactgtgggttatagatgctaaacga

SEQ ID NO: 1988 - DNA, 422 bp, Homo sapiens
tcaaaaagctgttataaaagaagaatatacatgaaaattctcaaactataaaactccaagtgctgcacatacacaagggattattatgatacaaaataaatggctatggattgtgaagtcatgaaggttagatgaagtagcaattaaatcagccaactcgctaacctcaaaaaacttgtctgcaggtataggtggtgcccagcctgctatgctatgtaaatatcttttaatgtatttatctcttgacttgagggtccatttataataatctccttttcatctctgaccaaaagccgtattaaagataaaatgaatgggtgaaaggcaaaaaaaaaaaacagaaacctatctttttccacagttaaagaagtttgtatctatgccatagtcaaaacaacagatttttaactccataattatgc

SEQ ID NO: 1989 - DNA, 1071 bp, Homo sapiens
gcacctggaatgactattactttcctattttttgaacacatacctcatgttaagtatattcttataaattaaatccccacaacctctgtctagcacagtgcaggcacatcaacttaggatcaatgaacatctcttgctgaagtcaattaattgccaaataagacttgcaagtaaaatcagagagaaggggagatttgttatctctaccaaactgatggtacagacagtaagcactcctgctgtgggctgtggtgcctttactcttcctttcaagtgatgtactctgctgcttccaggttcttaggtcttttgcaggtgcctttccaacaggcctgaggttccctaaaggcaagtactacttgtctccattatcttccccgatgcatgtcgaagataaataagcacacaatacaaagtaggtgtagatgctgactgagacaatggtagctgaaatgagacagggcataaatctggtagagagggaaaaaggaccttggattccaggaggatctgtgctgccagctagttacctcattcttccctcctcagcacccctccccaccacatcttcctgaacatgcgggttcctagcctgagttggtaatctttctgccctagccaatttattttctaatcttgtagctttcatataaagggctctccgtgagattgatgatgacagtctgggcagccacacagatgagcgggctcccctgttaattactaccagggagggaaggcactctattcaagggaggatagatcaaggagctaagttatatcagaagggggcaatttcaaaagctggaaagatctgtcaaaaaagtgtgtcctatgggaacccaggcagaaggaaggagaggagaaaagggaaactaagtcacttggagggagatggctccttcttcatgcccaggttcttccttacaagtctgtgatgagggtaggtataacaatagatggaaactgctttgaagaataaaaacactgtataatgcttggtactgcaaggattattgtattaagtggattcttatcctttgcctggtttatgtcctggttcttgcaaca

SEQ ID NO: 1990 - DNA, 1095 bp, Homo sapiens
cagtgtttcctagtcttctttgagaatgcccctgttaagataggtgagaagcaccaggggtaggcgagattcttggataatgtgtgtcctggaaggtggtgtattctggaatggggatgggaggaggggaaaaggataaagaagggaattcttttcgtttcaagcaatagaaattcaaactgtgatgcctcatggaaccagaccatgagaaggtcatgagcgcctggaactaagatctctcgagtgctccgggacgcttctcgcctcgtctcttacgtgtgcttcttctcacattttggcttaattcttcatttcaggccagctttctctcttacagctgccaccagcagactggacagactcctgtcctctctggccctaaactcaaaacttccaggagggagctcagatgagcgggcggttgggggtcaggaagcggctgctcagatgaagggggtgctggggttggggtgctcaggagcatctgcctgtgtggaagacgctatcctacaagaaggctggaaagacagacaaacgtcaccccctgcattttttgatggtttgtaggaagtgtcagtgagcatttaggagaaaaacccaagaccaggttacacagagcatgtcaggtctcaaatcccgacatgactcctgtcaaacccagtgccagggaggaggggagcccttcacccaatccgtatttaccgagcattgactgggtgcctgtgaaatgaggacttgggggggttcattttgtggaccactgatttcacaatcatttagcagtttccagggggagaaaagtggcctgcgtattcaacagagcttagagaagagactgtgtagggatttgcccagggagtgcagtagggagaggtgcatcaccaagaatatcggagacttctccttagcaggctcatcgtttccaaagagatggagatgcagtcccgagatagcgctccggcttgctggggacactggctccaggtggacagtcttacgtctgcctggcaatgctggctatgctggctatgctatgacctgcttcctctgtgaaacagctgctgaacaaaaatgcccaaattttagcacatcaat

SEQ ID NO: 1991 - DNA, 568 bp, Homo sapiens
tgcaagccaccatccccagccaagcacattaatctttatgaaaatgttttgtttctgcctttccccactcttgcaatggctcaccacagtcatcccattttcccagcagcgtggaactcacagtcagaagggcccattctccaaaattaaccccacctgagagttacattatgtaacacactgggagtgggggacaaggaacatctgtctccatctgtgccaggtgctaacttcctgtgtcgcccaggaacactcacctaacacctccgagtgcctccacaaaagtgccaggccatgtatgtgggacacttgctctgcagtgtaagcaaaaatgggtgcagttttaaaaatattgtagaattctagaactttccaaataagttggataatatcagcagttggtattcatataggttgaccttcacttggcagaacagtctgaacaggtgcgtagattttaagtagacttgaatttgaaggctaaggtcatccagatctctttgcggatgtggagctggaatgaagccctcctggctttgcctcctctgccgtcgtcgcagccggcagg

SEQ ID NO: 1992 - DNA, 777 bp, Homo sapiens
ctgtgctggagaaagtggggtatgaggcccggtttggggctgtgggagcacctcttccttctgttggtcctaggagctcagcgcttggtgggatgttccagaccaggagaggctgggactaaaattccagagtgatctatgggtgcagaagcttcagacgcctgttcaagagatgggtatcaggtgaggtgagtccatatttaggtctccagctaggatttaaacctataaggggaagaagcacaggtgagctacagtaattttggctaaaggtccaaactgaggccaatctcagggcatgtccctctaactagaggtaaggcatttagtcaacagccctccaagctcaaataggcagagggtagaactgagggggaatagcagctgttactaggaggctggtcactggcaaccttgggtttcaggagcgagaaatccatcctggatactgcgaacgcccttgattcttagaaaagtagggtcctggcatcaaagctggagcagtatggaacggatgactgcttagacacagggccagtgggtgatcaactacagcctcgtagatttctctttggaggactggagtgactcccaggctcagtaggggactctgtaggggactgagcttggagaagcccacggccaccctgcctccattccaaacaagattattcactccactcctgtttagctggtcacatggctcccccattccttgctctccattgcccttagtccaaagtccaaattccccagcccaaggctgcagggggctgg

SEQ ID NO: 1993 - DNA, 167 bp, Homo sapiens
ccagtgagtagtttttggtgctgcaaagaggacacactttctctcaccttcgggcctttgacctgcccgggcagggccctccccatcttcctcctttgctctgaattcatccttcttcttcaagctttaatttggatgttatcccttcaccccgcttccccaaggaa

SEQ ID NO: 1994 - DNA, 478 bp, Homo sapiens
gcagagtttgtccttctttgaaccaggtccctcctggacaaggaaggtgctagatacatgtttgtctagccacagggatcagagctcagaaggttgcggggacagggcatcctgcctgccctctctgaatgttcactttgagttacttcagttactctttacctggacaacataacgtcggggaaaactcatttatttgcaaaaggcaaaatacatgacactgtttcactcagaagcccctcagacccagcatctcgccaacctttgggcttaagaagtggtgaaaagatggggagagagtgactgaatgcatttttctgtctaggcaatttagtattacaggagatgctctcaaatccttgaccggagtgaaggcagagttcttgtcagttatgtaagaaaaacagctcattgttatatgatgcacactgaacaccatcgtgtgttttctcagtctttgtgtgtgcggacacgtggc

SEQ ID NO: 1995 - DNA, 33 bp, Homo sapiens
ggaattctgtttttactacggtgagtaacaagg

SEQ ID NO: 1996 - DNA, 107 bp, Homo sapiens
taacaaggttttttgttttgctcctgtaggtctattttttttttttttccaatcagtattttcaatgttttggctccagacagatttcagtggtgcatcacatgtta

SEQ ID NO: 1997 - DNA, 1289 bp, Homo sapiens
ttgttgagctatgcgtggagtgctgcctgacagcttgctattttctttctttcctgtgagataaaaatgtaccttatggtattactttattttaattctgccatgacatttgtggcggttgttttaagattcagagattactgggtgttgatctccttatgatactctcggttcctaattatgttagaaaaaaaagcaaagcgggaacttggcttttgtgttgccttcacagagtgtggaggttgaaaacatctcagcgcacttcacggaggttctcagagaccccataagtttctggaaaagtgggaaacgcaaacctgtcaacctgtcagtctctcccctctcacggaagcctgacatgtaaatctcaagttgttaaacctgctgtcaaatgagctgcctccactgaagactcccctccgctcctcgcactctcatcactgcccctcactctctgtccccacagcacagggacagcctccgcagactcccgtgtgtgtgctctggagagaaaagattctggatttgggcggtctcacctccaaaattgcagcccctaaggggagccgtgctaaggtgtgatacaggccatgccccttctagccccatgggacacctgactgatagcagcctgtgcagatgtgaggaacagaaggtggccccagaccccttaggagaaaccaaagtgcctcagagacaggacaagtgctaccccggaggccagtcaccaggtgacctgggagctgggaaccttttcagcctatgggtggctgtttatcacgaggggcattagacagacaggaggcagtgctgaaattcaacagcacaaagcaatttccagcttcatcttggcttattaataatgaaacagcaatagcgcaggcacaaatcaacagtaagtaggtgggtgggtgagacaagttggacatttggggaacagcctgggcagctaccgatacagagggaagccatttggtgtgtgtacctcccctcttccctgggataggagcaaacctgaaatgagaacggcagtcatctgcacacaaaaactaggttaggaaactgttttctaaggggccaggttgggtcactctttgtgacaagaaccgtgtgaaccacttcttacctgtaattctgactcagcattgatatttgaaaattcttccctagggctgggtactgagtactgttctgagtgcattacatacaacagctcatttacatacgtaatacattcacatacatcaatcatttgcatgtatcaactcatttatgtacatcaactcatt

SEQ ID NO: 1998 - DNA, 978 bp, Homo sapiens
tcatgtgcatgctgcatctctgcatgcttcctctgatggtttgatgtgggtcaatcctacgtctgtgcacatcttaacaactatcgtaggtgtagggtgcctttggtttactagaggtttcatcagtccacctgattctcactactgacgtaaatgtcagaggtggtcctgcctcttctcagtctccatcccaaggctctttacagctttctgtggcctgattttcttgctgtggatgctgaagggcactcttcagtggtttctcccagggccgttgcggattgcagctgtttcatacccagatgacctggggggcatcttcagtgtgtgcagatcagactcagcactgatactcgtcctccagccgtactttgtctccgcggtggtgctcagacttaaagcacttctcagctgtgctagtggtcccttcagagaacgaattatgctgaggcagagagggacctggggagggtagggaaggtcacaaattaaacagcagattagaggacagaaattcggtttgtggctttaatattttatactcagtatgacaggcagactcttcaaaaaaacataacctagtggcccaaatcgcaattttacgttatactttcaatataggaggaccctcacattgcttaaaaggggtcttcagggagaaatttacccaaaatttcatgcttggctccgtggtgacggcacatcctcactctgagaaccaggaccggcctcgggagtccaggttctgttcccagtttgtatgcacaccgatttccccactgtctgtcacaaccagtcaacttcccatgtgttaacagttactgaatctacctgtccgcacgtggccaagccccgccccccccttcccccatgctcttctctctgcctggccaactcctcaatcttggcaaagtccttcagaacccttgggtagtgtgagttaccttcctttgtatagaatctgaaaaatcattgccc

SEQ ID NO: 1999 - DNA, 570 bp, Homo sapiens
ttagtacatgtttgtttggggaatgaatgtgaggtcactagtcaatgattctgaaatgagtctattgaaggtggaaaccagcacaattcaaatgctttgcgttaaatgccagtcagtgtctcttcccaaagacccccactgaacccatcagatgtaaaatcccccattttatcaccgaacaacctgtttccacccatttcccttattcactaaacaacccgtttccacccatttctcttgttccttcttattgcagtgggggacgtgtctttgccttctttcaagggttaatgtttccaagtgggttctatcttctcaaggatcactggtctttcgcatataccctcttgctcccgaatcattaagaactcctgcccattggatgatgttgctgtatctccaattatattttgaaactttctccctctcacttactcctccacgtgtcccatttctctgccttcttaatggccacttctcaaacacatggctgacagattccggaggccttcaactcccacctatgaagcagccagtggcctcgggagtggggctgcttgagactgtggg

SEQ ID NO: 2000 - DNA, 31 bp, Homo sapiens
ttagaatatgtaacgcaattaccgctgcgtt

SEQ ID NO: 2001 - DNA, 283 bp, Homo sapiens
gtgttgaacttgaccttgctctcctcctcgggtcaggcctgccgaccctgcactacaggttcctttttctctccctgtccgtgcatccatctgtttctgcactctcttcggtgcatcctctgaaccaccagaattaggttcctccacaccaaatgtgatcatttcatttcgcagctagattgctcgtgaacagctaagcaggtcacgctgagctcgacacagtccaatcccaagtaccagtcaggctcccaccgtcccttcctatcccaaaatgtcacctccc

SEQ ID NO: 2002 - DNA, 292 bp, Homo sapiens
cctgggaacagattcgacctgggcagaatgctcttcagtttgttcctatctctgccgggatctatatgttctggactctcttctacgacacggagacctttcccggagcaggaacggggccacggccgtgtttgcattttctgaacccaggatggtgccactgtggtttgttctccccgttcaagtgttgctgactggtggggagggacagcatcgcctcagtgaaagttttgggttaaacactgtctgcagtaattcaaaaggataagaaggactcctttcactgtgcatc

SEQ ID NO: 2003 - DNA, 1406 bp, Homo sapiens
actgctagcaggtaggttatctctcaacatctccctgtggctgcaccctgccaggatgctcagtaaactgggtgcacctgtctcacactggtagcaggtaggttatctcacaacatctcactgtggctgcaccctgccaggatgcttagtaaactgggtgcacctgtctcacactgctagcaggtaggttatctcacaacatctctctgtggctgcaccctgccaggatgctcagtaaactgggtgcacctgtctcacactggtagcaggtaggttatctctcaacatctccctgtggctgcaccctgccaggatgctcagtaaactgggtgcacctgtctcacactgctagcaggtaggttatctctcaacatctccctgtggctgcaccttcctgagtagctcacttgattcctttaaaagtcctgtcataggtgataatagaagttatttccttagggagccagctgctgaacatgaattctgaaaccaggcaccccacaattaactatgaattctttcatggtcctgctacctcttcacaagtgtttgctttcagcacctcctgtcttccgtgctctggactcagcatttgctgaccacatgagtggtgggcaccatgccaggtctggccgcagagttagaaatcctgggtcctgaggcacgatcagccagtcgctcctttggcggtgctgtcacacatccactgggtgcccatttacttgcatttttctggcaaaaatgtctttaattctagtttgctttccagcgtttaaaaacaattatatcctaagtgttcaagtgagaatagacaaaccctatgcagtcacattctaaagctatttcaataaggcttctgactacctttcaaagtacatcactttttatttttaaagaaatatttacatttgaccataaataaactaaaattgaatttttaattctagaaaatgaagagcaaaacttaaaacctggttaaggcccctggtgtaaacgatacctatttacagatttcctatcttaatccgtcgcaccaaacatgaatgcctcctgctttccaaacgggtgagaacgtgaaagagccacattgtataccatctttctagtaagccctgggcaagttacaaatcattaatcagcctccacaattaatgagtcactcaaaatgacactcacttaatacagtgtccagaaataatttgccaggttgatctactttccaaatattttactacacaaatctattattttaattcttagcatctcatgaatgacactggtgccttgtgtccctggtagatttaatagcgatgatggtaagtctgttgataggtgttctgataggccttctctacccagcattctaccatagcgagacaaaaaatcttgggagactaattttaatt

SEQ ID NO: 2004 - DNA, 379 bp, Homo sapiens
gtgtatatatgtacatgtaagtaagtgatggattgtttgcataggaatcttaagccactgtaacaatctaggattatttcataaaattcaggtttcctagtacaaactcctctgacttctgaaggaggagtggtaatttaagcctgcacatgagattagcaacaagcaactcacatctccctgatgtatggaggccctacccactggctgaaacaactaccctttgtgtccagaaattagttctcctggtaatcagattcttgaagaacttttgagcccaagggagaggggcaagaaagaaaattcccttcacttacaacatgtttgggcatttctatgaggaaaaccctaagccaataaagatgatagctaggctttg

SEQ ID NO: 2005 - DNA, 794 bp, Homo sapiens
accacaaaactcccacctctttcctcagaagaaatgacttctatgaaagggttagttctgaagtggtattgtgcgtcggatagtaacagaacactggacatgaaagccatgtcaccgtaaacgcactgccgggaacattcccaacacacagcatggcggccttctccctggcatgtctcagagcaccggaaaccccagatcagaaacagctctcacatatggaagcagatgaccggctgattatcttgtagcaatactacttcctttcatcccaattatgtgaccatcactcaagcaaagctttggcaatctacagacaaaacccactttgctggttgatgtaccagtcattaggcaggacttccaactcccctgaggaggtacctgggctaagccattccaacaacactgttttgccctttgcccaatcattgtatctcatggatacagcattcaggaaaatgtaaaattaaagaccaggtcggctaacttaacttccttgatacattttgttaagctaatcaaaaaagtacaccataaatatctcagtaaattactgacaaccaaactgaataaaaattagactgacataaaatctgaagtgtaacagagaatctgaagaattctttaacagaagtgttcagttcatataagaggttaattttctcagtattgaccaagaagaacaatttctttatatgccagtcattcgtagtaacagccggcaattcaccttgaacagtggacccaaatcacgacttgttactttgctaatattttaaagattaccgttt

SEQ ID NO: 2006 - DNA, 26 bp, Homo sapiens
cctggctcatcattgtcctcggagta

SEQ ID NO: 2007 - DNA, 532 bp, Homo sapiens
agtcccatcactgtcgtcacactcatccactgaggagctgtctgctttcacggcaaatggctttcgtttaggagcaggttcctggggctgtttatcttgtgtttttctttttttcgccaagggacaaccatatacactaattaaaaaaatagagaaggcaggggagagagagaaaaaaaatatctgtgttactgtcttttaaaatcagaccaatgggggccttgatcaaggtacttaaaggcttatcatgaatgtcatcagcacaaacaccagagagacataacatacatgttccccgaagtgtgctgaaatctgttaatgaagtgatagtgcaaataaataccgctcacatttgtctagttaccattcacatttagtccaagtctcctagttcctcgttcctataattccagagatcctacgaaaattcatgagattggtttgcataatgtgtataacatgtaattgacaatacaaatttatgaaacattttaccaaatatatactatgtataatatacatctgaagcaag

SEQ ID NO: 2008 - DNA, 319 bp, Homo sapiens
gtctatgtcgtgaaagagctttggatatatttggatttgtatattttatggattaaattatatctttagacttgataacctcctgaaacaagatgagccctagggcttgtcaatgttgtatgaaagcaactgcatcattcaaagttctgcagaacttcctcagtcttagatgttattagtcccacgccagcattccagaaaacaacttcagtgttagcggtaatcaccactaaatcacgctgaaattggcccaggcttggatgagacccttccttacagcagaagctcacaatctttccttgagaaacaacgattttct

SEQ ID NO: 2009 - DNA, 477 bp, Homo sapiens
agaaagaatgattttcaaagctacattacaaattcacttttgttgtagaaataatatatatactacaaaaaaataggtgggttaggggagacatagaggcaaactaccgcaggcaaatactccatttatgcagaacgagatgtgtggcctctctcattggcccattattctgcagggtgagatgtgtggcctctctcactggcccattattctgcagggtgagaggtgtggcctctctcactggcccattattctgcaggggggctcctgcacaccttgactagcttggctttggatctggggtagtgaatgatcattcagtcatgaccctgaccagtgtgtactatttgggcaactcctctattttgggtcatgggctatgctggagttcagagatgagtggcacagatcttcacaccaaggctttatgctctaacaagggatttagacaagtcacaaataccattttagaacctc

SEQ ID NO: 2010 - DNA, 395 bp, Homo sapiens
atcaacttcgtggatgaatgatgggactctggattttgacccaggaaacagggagtgatacgagttctttcaagcactcaataatgcaattaaaatgcatgttggataggtgcgaagcggaggacagaagagaggaggtgcaggctagagatgcggggagcagaagacagccagcgccatgttcaggtggggactgggatgagaaagtgagctgaggagggtgcccagatcatgagacagatgagagaggccaggaggaccaagggccgtgagggagctccttggtacagtcagaccctgggtgagaaggtgctgggagagagcgtgagagcaggacacagtgtgtgtggaccaggaggagcttgcattgcccatggcaggtcttgttggtcaac

SEQ ID NO: 2011 - DNA, 231 bp, Homo sapiens
gaactgctgtgtaatagtgataataacaagaaacttttgctattttttatttttattcaggtatccaattatccaacaaacatgtcgctccttaaagttttggaaactaatgattgtcctgtttgtttcttctatcaatacttctaaaacgatttagaccaattgcactagcgaaagggaagagaaacaattttatgtttcttaggaagccagtttttcttgataggttgt

SEQ ID NO: 2012 - DNA, 49 bp, Homo sapiens
cccaggaagacacaagcatggggtaggggcaagagctgagggacttcat

SEQ ID NO: 2013 - DNA, 2771 bp, Homo sapiens
gggtgaaacgttatcatcccttaaaaacataataagcaaaacaagaataacaattttaatcaccagataattcaagaaaaaaaattcatctatagtctacataacatttcaaatatgaaataaacagatttctgggattccttttatattttcatttgtgaggggataatctgagataataatctcagagccagccacaccttcatgctgaatcaccaccggacaacctgtcaagtctaagcccaacaccaaccaacctcctcgcagggccacctgtatctgagtagacttgttctggtggataccttctgtgtttgttcagttagcagataatagatgcagctgtgcacggatggctcctccagagcctgcccttggtgtcgcgggtcataatgaccggagcttttcccagcttccttctccttcatcagtgcatcaatatgtttgtctgacacagtctgttctgcactgaggccacctgcacagcaccattcactaaaacagataactaggcccaccgtgaccatctatgagtcccgattgctgggaagtgatgtcaccccacttggcttggtgctattcagtgaggtgactgggggtaaggtggggctcctgtttcattttctccctgctcattcacacgcacagccgccctccttttcaagatggctcacttgttgttcagactgtgcgatgttggccccatgaggtttagaggaggggagtggagattttccttagaatggatgctgcagttagaagtgagcacaactgggcttcactcatgatcacctgggacagctgagagtttggaggacaatgtatccggctaggaggacgtttgagaggatggggtctgggccgtagggcattgctgtggtgggtgtctgagtcccaaccttggagaacatgtctgggccatcgaggcgtgggaggcgggctgcctcctgctcacatgtcctctgaactcccctgcacctgcagctggctggctcccttgcagagggcccgcccactttcattgcttttccatctcctggcagctgccatggctcctactccattagaacttgctgggcatgggaaggtagtggaggaagagggacaataaataagcaagagtagaaaaaaaatagttgatcaagatagttggagaaggtgagtgtgtgtggaaagtcaagtacacatggaaaagaaaagtgaggagttcatctggtctctgccaggacaatattggtataatcctatcaagcagggtttggtttaatatgtgaaacatttcacaaacagcctgagcgtatccagggtggtgatgtgtagagcacaccacacgaccaagggcgtgagctccaggcttggtgttgttaacacctctttgagcacccggactccggctgggccttagtttacctatcgatgtgatagaagcgtcggctgttcctttactctctaaagctttacatgttttaaatttcctaaatgattcccttcccgtggtgggaactttctgatgaagtgtacgtttcagtaccttctagtcttctattttcacttgaattggttttactttcctatccctacattttgcaagctcttggattcagcgtagcaacttttggaatcatctggcgtcaaacttccagtgcttcctgccatttgacatggttcattgctcacgatttgctctctatttgttaatgtaaagcgtgaatacagtcgtatccccaactacaaacaagtaccctctgtcccttctctctctgatccattctcctactgcagttcctggtatctacttccatggtggcaacacattcaaccaccaggcacattccattacatctgtgttcaactccacgtggctcgaggccctgcttaaatcaacacagccctcttggtctccaaaggtttagaatatttcaaatggaggccttggaaagcaattctgggacatgagtttggggagtgtgtatcctcctgccctcgtattctgtgaacagcgtgtctgctgatggggcggtgatctggaaagagaggaggatgtgggggcactggtggtgccgcccagcaacaccagtgaagggctcagcccaggacctcagctcaccctgtcagtgcctcagagatgctgtgcactctggtcacctccatggctccgcagctggctactgcaaacctctgaggcacaaaggcagccctttgtatttgaacatcattctgcaagactgagttcaacatccacaatgcactgacagaatgatgtttactcacatatcctctcctagatttatatctctttttatgatataaatctaaaaagatatttttatatctttaggatatttttaggatgatgatattttaagattccaaaaataatgcactgtctcttttttcacacagttgaaacttcaaagaagtcgtaaatatgatcactagtaagatcacggtagctcaatagttctctgttgacaaaatacccctcccgtcatttttccagagtgtgtccataacatgattctcaatgcagaagcaaggcagggaagctagcagtggccacatctcacagaaaaccatgctgtcttatccttggacttctcacaattcagcagcagccagcgacaggagtggaagtccaagacactttgggtagagtgaaaaggcaaacgcatgctggattagaaatgagaaaacctggcctttccatgttttcaccctatttaggttacgcagggttacacatggaggcctggcatcccgtcacccccacc

SEQ ID NO: 2014 - DNA, 515 bp, Homo sapiens
gagcaagaagggtgtattagtaattattctgggacaccaagggtaacctagggcttccctggacaaaacctaccctggaaaaatcctgcccagcatccctttcagacactcgggaatattagggagcctctgacttggaacaggcaggaatcgtgtttcactttgactccatatgggggctgcaagggtagagatcggggtctgaggatttggctaacgggccaaatgttttgggtttgctaaagcttcagccacatcatgcctcgagcattttcctatcactctcaaatttgtgtactttagggcaaagtcatttcatatggccctagcaccttcacacacggctcagtgaagccattcctggacaggcttcttgctgtcgaatgagccctccctgtggaaggcgcctctctttgaactcagacgcctgtttatttttgaactggaaaccagaaacttagaattccccagagccacaggctcagatcctttttttcaatgataacctgtggaac

SEQ ID NO: 2015 - DNA, 507 bp, Homo sapiens
ttgaaagagaagagagggatttgctgaaggtcacctcgtgttttcattcctttgccattctcaagaacattaccatgcccggctcctataggaaatgaagcaatgcgtgagaataaaagccatttgatcacacacagcctcaagtcactcacaattccgaaaagccttgaggctgtgtgcagacccgcgcggcaacttttagaggtctcacctccattgccaagtgcagagccgagttaaagactgttattatggagtccaagtgaggacaagaagagtcacactcaccatccagcaaagccagagaaggttctcgtagcacccaaggatgcacattgtggtcccctgggacgctctctgtgacgatgcccccactgctctccctaccttgctcagctcccttctcccaggaacatggttgcctgagtgtctctccccaccaaggaccccttaagcaaggcctcagggaggtggcgtggtgttttgggcttgaaacctgattctttc

SEQ ID NO: 2016 - DNA, 184 bp, Homo sapiens
ctcttctatgtgagtcgtggatgctacgggacatgatgtatgtaagagtgtctgctcgctgtacccagttccctgtcagtgcctagtgaggttattattgctctcactttcatatgtggtttctgaacgttggcactattggcattctctgttgcgggtgttattccatgccttttaggaggtt

SEQ ID NO: 2017 - DNA, 33 bp, Homo sapiens
cttttagtattacctggagtgcctaagattccc

SEQ ID NO: 2018 - DNA, 261 bp, Homo sapiens
caggcctggggaagctgttagacctatgttcatttcacttgttttcctcctggaggtgctcaccaggcattaaatctcaccaggcattaaatctcacgtgtccctgtgtcattgcaaggcagtgcggatttcagaatcctgaagctgaagcatgtcaaattgaaactaggagcaaaatgtttcgaatcttaattttttgtttcaattcttgaaatattgctgttgttcaaaagcatgcatttctacattgctcatgtgtgg

SEQ ID NO: 2019 - DNA, 141 bp, Homo sapiens
gcgtgagccactgagcccggtgctcatgtgtttgaatgcatttggttacttcgtttattctcttccctgtagcttcacaagtaatatctctctgtcgcaattcttgtgctctttaataaactgttgtggtatctgagtcaa

SEQ ID NO: 2020 - DNA, 66 bp, Homo sapiens
tgtgcctggtgcctcgggacttggtggtggctgtggtgaggcgtgtgggatggccacggtgtggtg

SEQ ID NO: 2021 - DNA, 605 bp, Homo sapiens
tctgggacacaagggtgaccctggtgagctgggggcgagtggggggtgagagggcccggcaggggctggcagtttctttctctgtcatcaatttctcttcccaggagtctccttcccagccgcttgctccttaggtttgaatctctcctctttctttgcctttcccagctctctccttctgctgtctttgattcggtctctctagaactctcagcctctctctctacaagacagcagaaatctcgggggagttggagagggaggcagtgaggattttctgtgtgtgattattttagtaagctagcccaggttttcacccaaacccactgtaaataaatgctgtcctagaagctggatccgctgagagcgcctatctatcccagctctgcctgatcctctttcctcggcttggcttctccgtctccaggcctcatatctcccagtgcagagccaagcaacatcgtccttcccacctccaccatcctgccccaaggtcagtacgttgtggctgtaaaggaaggagggtgtaaaggaagcaaggcgactctgtccatgtctgtcctccctgatagcagacgctgtgggccttccatgccaccaggaca

SEQ ID NO: 2022 - DNA, 485 bp, Homo sapiens
agacacccacacccgtcagctgacccatcccctctctcctctctctccctgagaccaccaccctgcacgttccctccctctgctcccttcctccgtctcctggctcatgcagcaggtcaagcagccgtggacgggcggctgtgggctgctgtgttctgcaatgtgcacccagcattcagggcccagagcctgctgcccagaccccagggccagacttccaggaacatccctggaaagggaggcagccttgaaaagtccttgatttactgaagttggtgcccagaaggcagtgctttctgcaggaagagagcttgtccaggctgtgagcaggtgagcagagacgtctgcaggagaaaaggcataggccaggcctcaaggactgtgtcccacaggctgctgggagaggagcagggagcagagagagaggggggcctggagcttggaaaccggcagaagaagtcaggaaggattgtgaagagggggtc

SEQ ID NO: 2023 - DNA, 969 bp, Homo sapiens
ttccaaataaggttgcattctgcattcctgggaagaacatgaatttgggggtgctcttcaactcaatccagagtctaagggaagccaggtgggtgcagtcttgctcaggcttctctggacgtgcaaaaataaggtcccagaagacaaagctcacattggggccaggctgacataggtgtctgggctttccctgcagcaggtagatacctgcagagtctgtgggtctccacacagggacgcacactccaagaaaggccccagggcagccatgcctccttgtgattctttgcgaggggagggagctggtcagtactctgtcttgtctgtgatctgttgcttgggataaagggatcaaaacaccatctgtgccccgagcttgtgtttggtaccaacctgcaggccccggaggatctgtgtggtttggttggatgtgctcagcgtgtgcccacctggaataagacttaccactcctggggataagaacccatttcctgaaatgagaacagtctggccaaggtccatgtgctgcctcactttcctgagtagcctgggaactcaccaatgcctgcagagctcagcacctcatgagcacagatgaagggtggccatggtgagccacgtgactctgggtgaggcagagcccctctctgggcctccatagtttgggggttctggaggtggcttctaagcctcccaccaacttgagtagtagaaccttggatcattgcaacagtaccattttttttttctctgcagtgggctataagtttgcaaagcctttttaaacattttgtcttattgaatcatcttattattctcgggccacagtggacaggtgcaattttcatgtttctcaagatagacagcctgaggccccgggtctcactgtcaggtaggtcaaagctttgagattaagtcctgtaatgccttatttcagtgtcccaggtccccagatatttccctattaag

SEQ ID NO: 2024 - DNA, 41 bp, Homo sapiens
cacactgagagtctacacttgagacctgtaaagcagggctc

SEQ ID NO: 2025 - DNA, 1027 bp, Homo sapiens
tgcaaaagaaaacaggtgtatcttttattacatattccaaacaccacagatattttgaaaatataagtatgtcaaccattgctttaaaactgtgccatctattgctctctgggaacttccccttcttgagactcagctctggtccatcatattggaggatgccgaatcctgataaaggatttctgggcagctctgaacagaggacaaaagagatggagatgagcctcctgtggttggagtcactaacacagtcacatggtgtcattgaatgcctgctgaaaacacttgtccgagcagcgctctggagcatagactgagcctttgtgatggtcatagctggtggcctgtgcaggaatgagttagcgtccctccaggtgggtgcggaggaggaaatccagccccaccctgggagacctcctgggttcatcctggtctagcatgaatgactctgtcttggatacaccaggcttccttcccctttctgcagtagaattcatcgaattctgccagtgcattagagatgtgggcttaagaaaatccaaatgacatcaatcaactagtgatgaacaaatatttgcagagcccttcctcaatgtcacaccctcagtttggagctatagtttagaagaatatggggattaatgaaacctggctgcttctgttacattcaagaggagaaaaccaacaataaacacacagatggtacgtcagatggggaaaagaaggcagggggagaggggtagggaggaagactccccactcctgggggattcgctgcggagacaagatttatgttcaggaaaagttaacatgcaggaaaagtagttacaatatagctccttagtctgaaccatgactagataatcatatggtgagcctttaaatgtacctgtgggatacggaaagaaaggacctccttgtgtcctaacccatggagcaggggggtgcaataaagtactgtgggtgacagagttatttgaaggggtgatgaactttgcgggtgagatggcctgaattatcaagttca

SEQ ID NO: 2026 - DNA, 506 bp, Homo sapiens
ggcgtcctcgggttcttccaggcctgcctcttgcctcctaaacattttcatctgtttctggatattggtggctccatgaactttgggcgatctcagcgtttggttttcaggtctgtgactggaaggcagaagggatctgctgactccacctgcagatggactgagtccttctcgtgcccatcaccttaccgctaaggtgtaaaggactcaggaaagggacacaggagctgggtcagggtagctgcaatcgattgcttggacaagaatggaccaatgacactcacagctgacatcatggtggtgactttttatgaaagtcaggccagagcagacacaatgaaagttaaagcattgagtgtgaagtcttgtcttggagtcaaaaaagctgaaccaactagctcagattggcagggggtgatggggatatatggcaagcacaagggtatgagagaaggaccctagaaggttctaactaaaattaacctcaattttgttttatttttttt

SEQ ID NO: 2027 - DNA, 99 bp, Homo sapiens
gtgggcataccaggaagaggagatctactgtgaatatccgtcaggatgagaggtaacagttgtgttttgtacaggccaagagaaagacagcttagagtt

SEQ ID NO: 2028 - DNA, 576 bp, Homo sapiens
gggagttccctgctgggaccattccccagttatttacttccttgtaataggtcatgcttagcgtaaggccaaggagacaagacactgctgactcattctttcccagctgtgcaggctgggcacagagccaggctgcttgtccagccctggggcagatgccggctgctgcggtttggcagtgggtcagcagctgggatgaagccacagagtctgacctgtgaggagggtggtgggtccacaggaacccaggctctgcagcccttctgagatgggcggatctgggcataggaaagaaatgcaatcaggaatgcagcaaggcagagttgaaaagtcctgtgaagactgtgctgagcatcagggtcgggtaagcctcctctgggggttgcataggagctgctcacaatcatcccagtattattcacatcatctgtatttagtggcacctccttggtgccaaggtgtgagccatggccccgggtagcacagcctcctgcttcccagctgctggagggattgccctgatcccatgcttctccaaggtggtctgggggaagcaacccagcagcaactgtagga

SEQ ID NO: 2029 - DNA, 178 bp, Homo sapiens
cctagataagctctgctgcaaaacacaaaagtggccatgttctctcccagcacttgagcttgccttgagactgaaatccaagtgatgcccctcaggctatcacctctggtggatgcccctccagcctgtcttacccatgtccttcttgggccatcagccttctgttacctgctgggat

SEQ ID NO: 2030 - DNA, 26 bp, Homo sapiens
ttggatagaaacgcaatcgttattgg

SEQ ID NO: 2031 - DNA, 586 bp, Homo sapiens
tgtgttcctttctctgtcgtcactgagtgctcactctaggcagccctctgctaggcgcaagtggcaggatggaggagcgtgccaaggactaggagattacatggagaagctaacattagccttagtgcttctttgccatttggggaagcagattttggaagctgtcacttccaaggtggagttctgggaagtgtttgggcttccccttagcaggtgctccctaaattctaggcactcccctccagcactagagctttgtattctgacccctgaccctcacagccctttgcctttgatcaatgtattttctcagactggaacctccttcctctgcttttccctgtttatcaacctagtttagttgccccttgcttcagacaaccttccctgtctctttccctgcagcccccggagtactgtaaggccctccaccaacagacacctttcactttattgtcctgaatcacaggtttaagcttaagctgggttccctccattagatctctggagatccagaattagggtcagatttatttctgtttccctgcacaatatctgttacatagcaggtattgtgttggagagg

SEQ ID NO: 2032 - DNA, 391 bp, Homo sapiens
gaaactgaattgagtccatctcagcttctccaacaaggacagaaaagaaacagctcaggagacgtaatcttataacatggggtttctctgtaatttgcataaataacccactctactaggtttcacgcctcttgggagacctaccagctgcctgcctctcacttccagtttccaaagaggaaggaaggtttctaccagcccagctcagctggtccagggactaaattaccttcccatcactgagcccctttctcattatgccagaggaagatcactactgcctgtccatttgggcggcttatccacgtggcctggttccaggagccatctgtgtgatgtcattcccaatacgatttgaaacttccagcatctgcagcccccactggtgttg

SEQ ID NO: 2033 - DNA, 329 bp, Homo sapiens
cttatcatggtgagggttctagagatggggtggggccgggccctgtgtctccaaacgagcccagtgtatctcttgaggctggcctctccctctccctggtacaagccagggcttcaaaatccaaaagatctttcttcatcttttccaacccactatgacccaaatatgcatcttcctttaaggaatgtcttagatttaaaaaaattaaaaactcaaaagcttctgaggcatcttacctgagcttatcaacatctttcccccattccttctgatataactacttgggctgacttgaagcctcacttaggtgcagctgcaatggtgtgagg

SEQ ID NO: 2034 - DNA, 250 bp, Homo sapiens
ggtgtgcggttttatttgaatggagctcccgtttgaaataaaagctctatgatctaacctctcctgggcctcctgccttgcatccctaggggaagttttggggcataaaagtccaatttcttttcgtattggacgcttggatgagagaaagagaaacgaaatcctggcactgaaaaaagcagagacaaccaaacccaattattcctactaactgggaaggaattccatttgagttagtggttcccaaact

SEQ ID NO: 2035 - DNA, 976 bp, Homo sapiens
aaatcctccccatgcaataccctcaaagggccaaatccagtcccaagcatccctgtgccctcaggtcccctgggagccatacagtggagcccctagatatgtgggccaccaccctttctccttctctagccacgtggaagtctgaggggacatcgccccagacacggaatcttctgcctgtgcctctgtggcaggaagaacaagggcttagtcccactcttgacaccaccaggccgggcaggtccttgcccggctgcgcctggagaaaaggacagtgcaggtagaagaaaccaacctttcgggcgccaagtccatctcccaggcacagtccaccgcgtgtgcccaaggcttcgttcattgaagcttctaaataggagatggagggagatgcatttctggctcctggttgggaggtagcgaggggaaaaagagagaaaaaagagacagagcaaaatgttcatagacacccacagcacagtgctgaggtgtgcagggggaagttgttcatctactttgtgggcccacacgtgggagcaggcagctggcaggggcacaaatgggcgcatcgtttctatcgctcatgctgcataggcctggaggagcagggctggtgagtatgcataagaaaactgttgagccccacaccagaaaacatgcccgcattgcattccagtcaagtggtgttcaaggcagcaaaaatgtctgagctaattctaaggaccagaattctaatagagccggccccttctattggctgggaatgtttgttttgaaacagtgggctcatttaaagggatcattgaagagattcttcagggcccagttcaaatgtcatgacctgtctaaaattatttcttctgcatttttgtatcaccttatatataaccccagtataatatttactatgaattctctatgcaatacattgttcagcggtgtgccttggagacagcaggtgtttgttcagtgtttttat

SEQ ID NO: 2036 - DNA, 73 bp, Homo sapiens
ctttgcaggaagggtacccaagtgggaagatggagctttgatcagcttgcacattactgttttaattagctta

SEQ ID NO: 2037 - DNA, 458 bp, Homo sapiens
cacagagccaaaccatatcagctcatgaagagagctgtgtaacccaacaaaacatactgggcaagaaacaacaaattctcaaattagtttcctaaaaatcaaaatattaatggtagcaatgctcaaggccaaagctaagatgcctgtgcagaaacagataaaaagttaacttggcaatgcctgccgtggtataatttcacatctgtcaattgtttttgtttgcttaaagttgaagaaatagaccaaagaccaattgtaaagttgtgaagaaaattcactagatgaaaaaaagtaaaaacctcagattatgtagtgctttcccctaaatattggtaactctgcagctgccaacaaacaggacagcatgtgaacatttttgcatttagaaagtatttgaattttaacttgcaaaagaaaacaaaattatatctgttgcattttcaagacaatttttaagt

SEQ ID NO: 2038 - DNA, 213 bp, Homo sapiens
cagccatggaaaaggctgtgaaaagctatgattgctgctctgaggatctgggctttttcttctcagtactgtagtgaaaacagaaatgaaaaccttgaaaagtaggggaaaacccacattccattaagatcctggcagcgggtgcaacaattattctagaacccgcagcagccttttcatttgtatctaaggaatggtggatggactccctct

SEQ ID NO: 2039 - DNA, 730 bp, Homo sapiens
tgggtccccgctggccaagggtcagcagagcaagccctctgtcaggttctacccctccatagcctccacactgcaataattcctgtgagatattccaaagctcactttgtcttataatctatattgacattaactaagaaaagtaaaaacatataaagaaaataataaaatgatcaactcaatcgcaaaagtcactatactcaaaaaccacaagttagcgaccttactgtacagatcactctgctagattgcttttgtttgtccccatcctatggatgatgaagataaggtgcaaataatgatgaaataaggcttaaaatttctaacctaacctttgggttttccttcacacaccctttagaaatatatttgttagatgtgattttgccatatcctagttttcctttgttgtctaaagtattttgaaattctaaactgtcccttgatgacagcactcagggaactggcgaagggacatgagatttggacagagggaggacgatgtggccaggtgctggccttccatggcaagggctgatggacataaatacaaaggctagaaaactgaagaggctacatgatgaagattcattaagccagcacatagacaaacaaagctaggtaagaacaatgcagcacaccccagagcaattaaagctcatgcacagccttgttgggcagggcaattgattttagcaggcttggaacaagaacgggcctcaggcatgct

SEQ ID NO: 2040 - DNA, 335 bp, Homo sapiens
acctgatttcacaaaacagactggaatgtgctgagaggctgccaggcaggtggtcagcatccatgcagtgggtgctctcaccaatgccacacctggagaggaggagggcaaagcagatgtcgtccgggtgattttcagccctgggcccttccccgttcacacctcaggcttctcagcatgtattgctttgccatgctttcctcagcttacagtaataactccttttgcctgccacccacactgacatgagcccccacttagagatggcttcgtgaatatttcaaattttatcaggtgctttaattaaatcattgacatttatgtcagagagtaca

SEQ ID NO: 2041 - DNA, 171 bp, Homo sapiens
tagaggataacagccaagacttctgatttcctaccagtttcagaaaatatggagctcccacagcataggaattctctccataacagaatgttatggctaaaagcatgacccatctaaaattcaacttcgagtatttatttaacaaataactacagtacttcattaactact

SEQ ID NO: 2042 - DNA, 129 bp, Homo sapiens
tagttgagccttctgcttataattcaaggtgacccacatgaatttggaacattacatccactacagcatgcctaatactaccctcagacattttagattgcaagagtaaatttcccccaagactggccc

SEQ ID NO: 2043 - DNA, 736 bp, Homo sapiens
ttccctcagcgactatggctatctatatatattattcatgaccttgctttaaaaggaattatctggttctgtgtctctgcaagattatcttgccttctaacacagcaaaacacatcagctttatgacagcaatactttctcaaaatttttttctagacccagtggcatgtcccagcttgatgtggctccataagtgtgtgatattgtttaagattctgctcaaatggactccctgattctgaaccttgggaaggaagggtatcagcagcatcggaagggaggctctctggagtttttctatggaggaagtcgccacacacacaaatgccgcattgtcaactctctagaacacagtcatctcacaactgtggaatgtccctccttgccaaaccctcaggacgacagcagttgaaactttcatatacggaggagtggaggctcctacggaagaaaagaggaagagccagtgcttgatgcaggcttttgacacttcaagttgggcaatgtttttggtttcagcaaagttgctaaaaaccacaattcccaaggttggcctgaactttgattcagagcttgaattgctaagaaaggtggggctggccacaggtttcacttggcagcagctcgcttcttccctgtgggcggctacccctgctgtccttttccatgcggagttcctggccatgggtccatggtcagtaggtgcttctctcttacaccctgggtcacagcacag

SEQ ID NO: 2044 - DNA, 720 bp, Homo sapiens
tgacaatagaagaaaaggaaatgcagacaaatgagaagaaaaaagtgaatttagaaataaagggaagattcaagcccagtgagtgacccctgtcatcagaggggtgtggcaggtggccctacaagagcttcacagcgcaagtcaacttcccatgagcccagacaggtctacagatgtggctctccagactctatgttgagaggaatgttgaggccatacctcagaaggaaatcacacagagacaaataagcaaggctgtgtgggccaggaggagcaggggacaacctgccaatttgcccctaagggcgagaaattgaaactggggttagagagttagacaagcaccttggatagagccctatagtgttttttgtttttgtttgtttgtttgtttgtttttttactgagcaggtcttactatggtaacacctggtcataaaattctaaaatcatttgtttagaaaaggatatggcaattcactgagcccagttccccagccatggtctccagcacacttccactaagaagcccctagcaatggaaggtcagctgtctctaaaagctgtgcattctatctttggagaaatgtggacctgaaacgtttctgcagacatcctggccctccctgaaagttttaccctatgagggactcaacagaggtgatttgacattaggacactctgatgcacacatgcacacagtagttctcagaaatgtga

SEQ ID NO: 2045 - DNA, 55 bp, Homo sapiens
atgacagtccttcctctagggtgctgggcatgccttcgtttctctattctgtgag

SEQ ID NO: 2046 - DNA, 381 bp, Homo sapiens
ctagaaaaatacatattaaattttcagtgtgacaagtatataaaataaaaaattccacaagaaatcttatcaagttcctttccatgaaaagaacgaacttgaattgttattgtctgtcttgcgttgagtctttggactcattgttaattgatccaatgtcattttagccagctcttaacctccacactttttcttccttcataggaaaattccactgccacaaaaagtacaaggaaatatgctatgcaatcctacctttatgaaatttacaatctagtataggagatgaacttaaaataattgtaaggaagctgtgaaccatttctgcaatacatgtttaagcgtggaagggagagttgcgaagaaggcattaacagcaac

SEQ ID NO: 2047 - DNA, 40 bp, Homo sapiens
tgtgaaaggtaagcaaaacagagcagcctctgctgtgtgt

SEQ ID NO: 2048 - DNA, 1058 bp, Homo sapiens
tttctatcttaataatagagatgttatagtgaaaatggcacacaaaatgcaccaacaagatctgttttttttttttaggcccttcaactatttttttaggcccttcttgcttgtattttatgatttacaaattttcatacttttgtaatcaggaaaaataaatatgatatcaaacttaaagttaaaaaatgcatccaaaggcactgacgtacgccaggcaggcaacttcattctcccatgtgtccaacacagaactcacaagactcttggctggatgtcctcttttcaggaaagaaggttcatttttagagataattacacactgtgtaagcatagaagtctcccttttattctgaatggtttcctgaaaacgctgtaactactgcatttagttgtggcaaacttgggtgttcaagaggcatggaacagccagaaagggttcataaagcctgggccagattcagcacaaagatttttctaggctcaaaaaagggtctgtaactggaccagactgatctgagcacctcctcatactttctggctgtttctgatctatcctcgacatgttacaccgtattcttgtttaatctttatagcacagaggggataaagaacacagaggcttaggaagatgagggtggtcggtgggtatcacatcgctaccttgatccaggcctgtctccgctctccgctgaaccaagcttacaccatggggtgctcatcctggccttgctctctgaggaactttccaatagtaggtgcatttattttaaggcaaaacaagaatctgtctgtaagtacatcttggagtgtgagggtcgagacggctgatgctgtctgtgtctattggttctgtcagtgcctgtttgaaaaagaggctggtattttatcagttttatctttgttgattccaagatgtttgtctcgtgattgcattttcttccatggctaaatatttctgaggggttttaaagtcataataattgatatcctttcaaacatgctttctcctgtttttctgtttttgactgaaactgaatctctgccttctttttctt

SEQ ID NO: 2049 - DNA, 871 bp, Homo sapiens
aatttctgtcttcttataagctcattttgggggtgaaagcctctttcatttctcctctggcttctgggcgctctcatcttcctccctgacgaccaggcatgcatgagaagcagagactgcccagcgtgaacctgatctgtgtctgctgctggattctgacccaactggggatgcctgtgcactggagggcaaggatacctgaaggtgttttcacaggggatttggggactgcttagaaagagctaagctggagcagggcctaacataaagagcacaaactagagattctctctggttgtttaggaggaaaagtgacggaagtagatgttgcttaactcgctccagacctcacctccactgtgcaatgacacagtgctcacaaatggctggtggagacccgaactggagccagaggccaggcaggatactgcttcgtgggaggatgaagaagggctttgtactacctgccccaacttcgacaccatttgcagatgaagctccaagaaacatgaaaaccagacagctatagcgctttgggtggagtgtgctgctgggcacagcaaatataaatggccttaaagaaaaagcagaatggacaatgaatgccatcccttaaagcgacgtctttgctgcagcctcttcatttgccctcggattaatgcgtgatagtttcctgtccctggtacttggggctgtgcagtgaggtgagtaggacgttacctctggggggtggaggagaatcagataaactcagccagaccaaagagtgagtgactgaagttctctggaaggacaggcttcagtcctgggattgagggtagcagttaagggtccatttggcttaaggcagagaaaggtatgttagcctgtg

SEQ ID NO: 2050 - DNA, 89 bp, Homo sapiens
gaaaatgggacaccaatgaaaaaatgccaggcatccagaatagaactagataacaaaagtgctaacagaacttagaagtgagagggagg

SEQ ID NO: 2051 - DNA, 550 bp, Homo sapiens
aaagtgagagggagagaagagggggctccttgtccccacacgaccactgcacctcaatttctcctctagagatgtcccgtgtgcaggcatgtgcaccttgtgtaccactggccacgacagctatattgcaaatactctgattttagtcaactgtgccaccctttcctagaaatagtttaatcagatagcaaaaatatatatacaacaacgaaacataaatattaaaattcaaagtgaagtaaaaataaaggaaaacagtaaaaggtaacgcagtggagaaaatgatcatagtacagaaaaattcatacagagagctttctcatagttaccaactgtttcctccaacgttctgtctaagcccctcataaccaaagcaataggaccacataaccagttttaagccttgtattgttcatgggaacaactggaagctccgctgagggttcaccatgtttgtcatcgcctccccagcacttctcacagcccctgacatggcactagatggcggttaatagatggacgatgaagaacatgaatgatgcataagtac

SEQ ID NO: 2052 - DNA, 132 bp, Homo sapiens
acaagttaattcattttttagcactcagatgtgagggacatttctcttgcacatctaaaagacagcacaatgatgaagtgaaatgtatgtggctgttattgttctaatagattagaaggtattagtaaacaa

SEQ ID NO: 2053 - DNA, 132 bp, Homo sapiens
caaaacaaaaaacaagagcacctgtttcacacagattcctgtttccctaaggtaggttgattcaggtaggttaacctcgctgggtctcaagtccctcatcttttaaatgggggtcatttaattggttgccat

SEQ ID NO: 2054 - DNA, 47 bp, Homo sapiens
cactctctaagtcatagctactattattagtagtattattagcagta

SEQ ID NO: 2055 - DNA, 652 bp, Homo sapiens
gcctctctttggtggtgcacccattctatttcttaaaagcagcaccttgggaggaggctctctgcctcccatcttctctgctaggggatacatcagccccaagaacatcctctccctcactctcccactcctctctaagtgatttcattctgtacatgagacactgtgatttttatgtgagaagcacaaagcatctttcatagaattttagcttcaaagacaacatcaaaaggttgtgtttgatgtttccgaaggcagcatttcacttcatgactattcaacgacaggtgatttgactgatttttctttgtcagtgttcacccagatgtttggcacagcttgacaaggagagtgtctgagcgctgctcttctgtcgttgtcaagagccatttgggaatatacttgaaatccaacaacaaagatacactcctcctcagcttttctgttcactatatggtcatatcagtatccttgaatgacaaacacactccagcattcatcctgatggtaacttacatcatgtgagtcatgagttcaaggaaagtctaatctgcggcattctaatctgaactccaaacagccctggagattattatccagtaatgttatttccttacttcccttctctatattctaggtattataggaggct

SEQ ID NO: 2056 - DNA, 627 bp, Homo sapiens
taaagttgaaactttaaatgtgttcacaaagtggtggttaaaaaaaatacaaaacaccaacccaaatagacaagtgggtgtttttttgttattgttgttgcctcttgtgctcaaagttgtctgtctctatttggtacaatgaggcaaaatcacagttaaagagtaaatgcaaatatcacaatttctgacttcatttagcctcactgcatttaccaaagctgtgtataacatcttgcctattcaaaatataacatatggaccatgtgggtgagagtgctaaaagagccttcatttgtgcagtctttgactggggaggcttcaaaacaacctgaatgttaagttgctattttaaaaaaagagataaaattttgacttttaaaaaccattgaaaagaaaggaaaagataccataggtgaagagtttcctaatgtctgcagggaaggttaatggagacctctgggagagcaggagtattctgaggtgcccctgccacaagagggctccctgggggcgggggtgggtacagagtcagtgagaagtctccagagcaggagggtgcaggcttggaagcgtttgaattctaacaaagaatgtgtttgaactattgaggtgtgtatatatgctttc

SEQ ID NO: 2057 - DNA, 831 bp, Homo sapiens
gtgtgtgtgtatgtgtgtgtgtgtttgcaagaaaacccctcctgattagcatcattttgtttgcaacaaaacccctctttactagcatctcaaaaagaaaagttccagtagtacaactgggaatctagcatttgcttctgcattgcttctataaagttgcattcttcaaaaaggaactccttttcagtttaggtcaaaatagattggagaacaaactaactttcagagatattttagtgaattttgggccagttatataacagttgtatttgtgtgtctgtgtgtgtgtgtgtttgcaagaaaaatcctcatgcttctttgtagtagaatctgtatcaaggaagaccatggataggaaaggaaaaattttagaaatctaccagaagtggagtacatggcaagttgtatgaatgttatattttaaaagttcaatctctcactagtgagaatttgcaaagtaggacttttaaacacctttcaaatgtgtttaaataaaaatagtctgattcattatagaaaactgtattttttattttagaaatagctagaactattttaatatgaaatcttctttatttaaatatgtgcaacttgttgcattttgtatagataatgaatagaatttcaatgtagttgttaaattaattcctgagagtttcatttcatcatatacgttttccttccaatctttgggtgacaaatttcaaggtctaaaagaaaattaaatatcacattttcagtcgaagctatgtttatttgatcaatgtaggtcattgttttaatatacacacgttccacgacaccagctctcccctctcctgctgagggatc

SEQ ID NO: 2058 - DNA, 345 bp, Homo sapiens
gttctttggggattgaataaatgatgtatattaaaagtttggttcatagtaagttgtccttcaataaacagtgttattatggagaaaaatggtaaattccattcctcctagagcaggggttatttagccaaggtccatctgtatttccacgaagcgcaagctgaaatttaacatttccctccattttgaatataggcagcaaattgcatcacatttgggaacagtttgggggccccaattatggctttgtgaagtattgcttatatttggatttacagagtatatacaattcctatctctctttgaactatggatattccatgttcatgggtaggcatattgtag

SEQ ID NO: 2059 - DNA, 97 bp, Homo sapiens
aaatgcaaaatgcaccagttgctacctaggtcagatcactgctgcttcatatacaattctttttctggtaggagtcgacagcaaacaggacattgaa

SEQ ID NO: 2060 - DNA, 707 bp, Homo sapiens
accgtgatgtaggtaatcatagttgtatcataagtacatgtgacagtggttccttctgaagtcaaactttatgactgacttaattaaactgtgttgttactaagcaagtagttcgggaaatgtaccttctatgtttttgtcctcagagaattaacatttgcttgagggagctgaaattattaactcatgaaacaccagcaagacccatgggccattattcactcattcatgcatcatatgcaacatggagtataggtcatgtgagaccatggtctataagggcagtatagatggtaggcagagcactgaaaagatctggaacaacctcatggaagaggattgggaccagagtcaaccctcatatatcttggtttctgtatgtcactatggagttactactttactggtctcaatcaaattttttattgatggcctgattttggaggaaacagaagtaacactgtatacagtaatatcgactttacaagtaatttcttaagaataggtttctttatggctatatgatttatttactttgttataatcattttcacagggaacatctcctgaccttgactttaatcttaagagacactgagtaacttattacatcctcatcaaagaacaaaatttattgtttaaatctctgctctcctcatgcagatcatttatgattttatggatatttgtcatcttaccttttttct

SEQ ID NO: 2061 - DNA, 348 bp, Homo sapiens
gactttccaatctgagtagtttcaagtgtttagcccatcccatctccataaccttttcagttgctcttattctgatgatcttcagttttattttttcttgaactgcagggggaagagctggccatctattacagaaacagattttgtctacgtttatacatagcgcagataatcaaaatttttgttttgtttgttttttctatatgaaggtgatgtttaacctgtcctactgaaacaccatgttttgatggatgtgttggctttttaatttaatttagtttaagtttagttttccattataacatatcgagtctgtagtggctccctctgttagtcagtgctctctag

SEQ ID NO: 2062 - DNA, 208 bp, Homo sapiens
ctcctcatttttattttggattgaataggtagctaaaaacctgtagtctaagtagaggtgatttttttctttctacacttataactggcagaataatcctggtccaggcctagtgcttcctcaagggagatgtccctgctcctgacccttttgtctccagtccattgtgtgcctagggaagacattattcctcaggttctgactgatt

SEQ ID NO: 2063 - DNA, 293 bp, Homo sapiens
tgatgtagggtgaatgtttggatagaaatagaagaagtcagaagggaggaaacagtataattaaactaaagaagcagaagcacagaggaactgagacacataaggagcagaggaaaactcagatttttgatgacttacaatgttctagggtcttaccatcttatatatgttatactatataaatacatttattatctgactcctctgtaagaatgcaagaaagctgcaggcaataccatgagcctgaaaagaaaaaaaacagaatttgggcccaccaaggtagccaagatagg

SEQ ID NO: 2064 - DNA, 638 bp, Homo sapiens
gaattatgttaattagtatatattgaattaagaaataaggtttataattttatgattctataaaagttatttgcattgatttggaactttactattaacagatctcagtggctggtacaggctaaaagtttttattctgtaatttacagatcattgttaaaaatatagatatgttggaatccaataatatgccttactaagcccaatatttaacctttttcattgacaaaatgtgattttaataactttcttgtctttgagtaataaggcaatatatagactacctatgggatatacatattaagtagcctttcccaaaactttccttttgatgaattagtttttttctaagaatagatttttttagattgaatattgagaatgaaaggtgtaattataagaggactagacagaaagcactaatgataacccaaagcatgtgattctacatattaacacaataatttctgaagctaaaaaattaaattctatgttgagtaaagttgagtatgaaagtacaaatcagaccatgaatattggcaaaatataacacaaccatgttttagaagaaactcaaattatgtgtgtctttgtgtgtttgtctgcacacaaagctgtaaaatctgcattatctcacc

SEQ ID NO: 2065 - DNA, 1784 bp, Homo sapiens
attgtattttattacaatatgtgtagtgtatactaacttaaggggatatatgtaaacaaaattaaagtcatggggaaaatggcatcttgcttcaatcttcaacttaaagttactcttaacaatcaatttataccattatgtcaaattttagtcatcactgcagaattttagacaactgaaaagagacaaagtaacaccaaagaattaagcacataaagtgatattgattaaaaagttgaaagtaaaatctaccttgactagaactgaacattcagatctatctctccagaggaaaatctaacttgaatcataacggttcatattttgactagttcataccatgtcaattagccacttataacttgaaaatacctttcctcagatgcatttgactatctaaaatcctactgagcatgctgtttggcatgtcttattcctctgaaatgaaatgagatgaaagtcatctactttctaaaaaccagaaaatcagtttgcttgtgatttaaatttcaaaaaatagtttgaggaaaacacaaaaagaatcaactgtttaaagtcttatcttttcttcattgcacaacaagctacttctaccaaaaacaaggagtatgtggatgctttctaagaactcaaaaatgggaaaaccaatatcggaagtctgggtgcatgaatacatgtgcccacatatgtacagacttaatctccatatctgccaaaacagattttaacaggtaatcccaacattctaaattcagaaagcagagataaacagttttgtttctaaatcagtggtattactagatgaaatgtttagtagaatactgcacatatagttcagcagtactttgattatatcccatttaaaaaatcaaaataataagcatattcttctaacagcaatgaattctcccgctttttatttattttgacatactgatatttctgtaaacttgcaagtggaagataagctgttcaataaaagccttcttatatatagagtatacagaaattattttaaaagtctgtttatgtaacagattattttggtactaacaaaaattaagatacaaagaattggctagagaggaaaccatcactaaaccaagacacacagggctttcctgcacttcatttcaggaaaaaaatttccaagtaattcttactgtgttagaagaataaagtacgtttgtcatagtatacattattgtattcccttaaagcggggactatttaaaatttttaaattaaacaatgtccaggcttacttctgtctgtacattcatgaataatcgtatcactggttacacacaattctctcctcatgcaaaaaaaacccctccaaaaaaacaacaaccaaaaaaacctcagttcgttgttttcttaagtctaagtaagccaaacaaactaataatagcaatttaattagcaagctgtaaatcagggaggtatagaaattcagcagttaaattatttcctgtctatagtactgctgctactcaatttattttcttcatgtattagaagaattaataggcattgatggtcaaaataagaatttcaatatcgcagcaaatgacagaagagtgagagaaagagttcctaatgttgtgacaatcttaatgatcctttaaaaggtaaaggactgtgtgcgtatgtgtggaaaggagtagaaaataaaagaagaaggttaagacagatatttaaagggaatgccgagatagctccattagaatatttatttcaaaaaaactgctctgaagtctgcccagtgtaccaaaaacata

SEQ ID NO: 2066 - DNA, 143 bp, Homo sapiens
aattatgaagatggagttgaacatgtaaaaattaaagttaaaatttcaggagaaaaatttcttcccattaagaatccattgtgttcaacccaagcatccattgacagatgagtggacaaaaaaaatgtggtctatccaataca

SEQ ID NO: 2067 - DNA, 130 bp, Homo sapiens
aaagaattcatagtatttatggtattgtaccagaatctgtttgcacagaaacagttagtagcattatttttctatatttttttgtttgtctgtttcttttttggttttttgaggtgaagtttcgctcttt

SEQ ID NO: 2068 - DNA, 2389 bp, Homo sapiens
ttgtctgcatttcttagcctagcagtcagctgacctgtacatacctatcacaaacccatccacatttctttaaaatattcagaaatccaaacttaaccctgcttcccactggcctgtggccttcagactgagggagagttgactaagaaatccccacttcttagcccttttcccagtataactactttgttaaaagccttcttttcctaaagcctataattatgtttgcctccagggtacccaggaattttttcttttaataaacaaagagcatcctacaattatcatgatgatttgtcgagggcaggccaagttcagacaggaggctgactcagctctggaaactgacacgcacgtgctggcgttttcgatcctgggggcacccgacagcgtttaggggtcaagaattaatattaagagctggagaactaacagatccacatagatgtccactttatactgccagcaaaacgggacagcagttgggtgggatttggccttcctgaggctggcggcaccgtctgtgggccgtgccatcacaaatggctctaggtcaacacctccagcctgcgtgcactgcagcatccggatgccgtaacctggtgctgctggagccacacgcagccagggccggcatgggcagaagccggcggagttggagcctgtcgctctgtcagccctgatttgcgggctgagcccagttttgtggccctgcctgtaatctccccgagttcaaagagtgcttagctgcttgtctttgtcaagagcgcagttggggatcttttatgtgaaagatgtagaattctcgggcagactttgattatttattcatcccccttcgtgggtgtgtgatcgcgcgggcactgcggagccccttgtcctggctgctcttgctatgaaattcattgagctttaaagccctttgaaagtagctttttgagggagggggaaagtttttgaagtcttgtttctctctccccctctgcagtgccgcagcatctcttgccaccattccatgcgcccctaccgattgacatgcgacaccaggaaggaaggtaccattacgagcctcattctgtccacggtgtgcacgggtaagtcctgccctctgcctgctgctcctggcgtgcagtcacctgccatggggaggctgggccggcagcctcagccacatctcctgcctctgtctttcttttgggggttcctgatctacattgtcctgagcgggcgatcacctttgctatcatggcctgggaccctgtgtgagcatgtgcgtgggcagtgtataaacaccaaccacccccgagcccacatcaccacttataaggctctgggcttccttggtgtatctatacatggtttggagctctttcttcatccatgaagtgggaatcctctctaggtctaagatcccatataagtaaggtgatcttaggtatctgttgttccagcataataattcagagcaccctttttcacttcttcaagtgtccccctttgaatagtaaattgtatagtcaccatacttaaaaggacaagctcaaagtgatgctttggggcccttcctattcccagctttgaagtccccaggtagaaggtgtggggtcaccctgtggtctccacctgcctaaccctgtccctgtcatacccacctggggcctctaagcccattggctggtgtcatttcttggcctttagggctcaaaagtcttggtctctggctatcccatccgtcctccttccaggaaagaaggcccctccttctccctacccccaaactctccactgctccccgcacctgcctccaggagagctcttacaaaggtcagccagccccaagacccctctcgacccagcatcttcatgcccacaccctccagccccctcacctgttcatgccaaggtgctgtctgtggttctgtcccatgtctctgtgcctggggccagctgcctgcccagtgtgcctggaatctccccccaacaggccacctccaagcctcaaccgaggagtcacctcctcaggggcagtgtgatccttcacactgagcgggggctgctgccctcaatccacagcatcatcatctgtttttgcacctgcctcccagccagctctgagctctcctctcacctctgtgtctcaatgctgacatgaataggtgtacaaccagtgctcgctgagtggagagcctctccccgcctgccgccacctatgaaggcacatcctccttcctctaccatctcccatcccagtgaagtcagtcaacacttgctgggccctcactgtgctcacagcattgtgcctcagcagagtcctgtttccggacacccattgcctccccaagacggagcaaacctgggacttctactttctttttaaaaactgttttac

SEQ ID NO: 2069 - DNA, 572 bp, Homo sapiens
ttgggaactttttgttttatttcggtgtgcatacctggttctcacttgactaggatccgctgccgcagccttatgtctgcctggtgggtgttggagtcatttccaccctctgctcacctccagggcccctccacctgcaggtggctgagaccacagctggagaaacctctggaaggtgcatgtgtttggaactagttgggccacccaaaaattgcccagtcagtggtgtctgagactcctaggagcatccagggagctcagtccctatttgggagggggttgctgttgctgatttcttgctcatgagtcatgtttggctggttccatgacacggatcctgggcatagcaggcctgcctcaaagtgctccctgcacgggatgttggtcaggagacctgggcaatgctgagagctttgtgcagagacagtccatgctggagtgcttctgcctgcaggtgaatgtcctggttcacctctccctatacacctgaagtgtgtagaggcaccaccagaagtgtaggaagaccccaacagcgatgactgccttcctcatcataactgaccttgtgaacc

SEQ ID NO: 2070 - DNA, 171 bp, Homo sapiens
tagaaatcaagttccagccccctgagctcaggccctccgctgcatgctggcctttcttgtgggagcgtaagtatggaccatgggtccctctgacgagtccagccgagcccttcttgacagcacctcggcccttcgttagggcactgccccgagtccagtcgctcccagaac

SEQ ID NO: 2071 - DNA, 319 bp, Homo sapiens
ctggctacaggcagagcccccactgagaagggaggccctcagtgccgtccttccctgtgtaggtgggagccctgggctgggaaggggcctgggtcttcaccaggctttgccatgctccagctctgggtagggcctgcttccttcccttgccagtgagggtggggtgtgcgcagagcacttggagaagggggccgtggatgctggcatgcagcagggaggagtggcccagccagaggcccacagaaatggccttgtccctcatggcctacacagctccttcactggttggattcctgaagagattcctaaggctgctgta

SEQ ID NO: 2072 - DNA, 89 bp, Homo sapiens
tttgggatcactgagccccagtgtggagtctggcatcagcctgtagaatacagtaaatcatatttataatttgcatgggtctgcagcag

SEQ ID NO: 2073 - DNA, 847 bp, Homo sapiens
ctgtgtgacatccctgcaaggtagttacttccgtgagggcaaggagaccaggctctggggtgcagatctcctccccagccaaggaggggctagtctggttaagccccagtgatgggcagcagcatggtgctcccagagccccccgtccctacgcggtcctgctggggtgggcttccagcggctccacactatcctcaagacagttggttcccgccagactgagtgggggacacagcaagagcctcggggctggccctgggctctggaaagcccatgccctcacctcttccgcccccagtgtcccaggtgagaaccagggcaaagcttgtgaggaaaatggccccgtggctctggcttccatgatgaatgtggttggagcccggtggagaatcccgatccatcaagcccatgttgtagctcgcttctccctgccagcaccaaatgtgtctaattacacagatgtttgcacagcaaatgaggtacggtgtcatctcatttctgtgtcagctgagcctgagcctgagcctgctgccctgagctggtgaccatttcgtgggtgtgcccgcccctcagcccttgcacctcctgctttccactgctcaagcacccagaccccctccccgttccctctcaggatcctgatagctccagggagggcgcacccagtgtgtgcaggctccagagaggtgttccctgcactctctcattctgccctgccctctgcccctccggagtaccttggtcatcacccaagagcctgccattgtcagttctcagcctgccaggctacccgcactgggacccattgccgaaccctccctagctgtgattaacatgaattaactca

SEQ ID NO: 2074 - DNA, 1127 bp, Homo sapiens
ctttggaaacattcaatggatatgagcaacaatcgtgatcattgttgttatcctcacttgctgatttgagaagggggccacggcaggctgggagactgggtggcagaggccggccacagcatgtccttgggagagttgactgtctggggactgtggcacagaaggtgggggatggggctgaaggagtgctgtggtgcggtgtggtgggggtctttctttcccccagttgaggaatttggacttcctccttttggcaaccaggagcagcggggagtggtcagatttattttcaggcagctacagcagtagttagggagtagacaggagaagggcgggaactgtggtgagaggacctgccagagctgccacagtggccctggggagaggggagcaggaccagggctgaccacccggctgtaaacaggcagctgcacgtggggaaggcagggcatggaggttggtgtgaggacagccttgcagcccagcccagctcgatggcctcctcatagacacccaagcccactcctctgcagagcacccttcccggtcacttaaggttcaaatgcacagcaggcttgcatggcttactgatgctcacgtggttccaggggaggaaagtcaccacccacccgtggactcctgctgcagtgtctttgggctgtgcaaaccacaagtgatggggagacaaatggggcaggggtgtgtgattgctggtcaagcaaggttctcttgaagcccccatggggacatccctaagtctccaagagtctgtacaagggcgagaagagaaggccggctgtgaatagggccacacacccccagcagtctctccaaccttgtgacgctaacaggaaagagaagctctttggatgccctctgggccccctgcctcccagaaataggcttgccagggtgtcatggggagcaaggctgaggtgtggcgaggaagggtccctaagttggtgctccccatttcctcagtgtatgtggtcacacaagcatgagtccggcctgccctgggccagcgttaacttgtgtcctggagaggaatgtagaagtccatgctcctggttcggggggctggggtggaccttcagctccctatgttgcttttgaggacctttcca

SEQ ID NO: 2075 - DNA, 65 bp, Homo sapiens
gggcttcagagaagaccaatttcagctgcttcctgcccagaagggcgtacagaaactgccccatg

SEQ ID NO: 2076 - DNA, 136 bp, Homo sapiens
acaggcgcccataggccagagtttggggaccactgcaggcgccgctgcttgcttgacgtccgggaaagcagccccagagctgcttgttggctttctggactcatcactgacagcgcctcgccgccaaaacacgggt

SEQ ID NO: 2077 - DNA, 390 bp, Homo sapiens
ggggttgtactgctaattattactgtttccaatatatccctgaaccagagactacaaaggtcatattcttgaaacttgttttcaggcagatgcagccacaataattacagctcaaagaggataagagcaacatattccatgacatttgcccttaactacctttcttattagcaatgatactgctacagacaatgactatattatacatccatgtatctaaatgtgctgtttattctgaagtgacagtgacaattatagcagctgccaggaaggaataatgggtatactccagcattggcagtggtgtggttagcagtaatgccaattcacaaaaaatcccacaccccaaaaggcaccaggtaatgctactgatgtgattctattgctaaa

SEQ ID NO: 2078 - DNA, 701 bp, Homo sapiens
tatgattattatttatttcttgattctggcttagggtaagtgttacacataaaaacgcaatgcatttcttctggccatgagactattttccacaatgaattctaatcctatgaactatgactacttggtttgaccttgggtatatgtgactttccatatgaaaatttcattatcatacgcttaagaataaaaaattcctagcctagagatgtaatgctatcacacggaggaactcaccagtattcactctactcaattatctccatggcttctacactgcaagcaaaaaagtgcacatttccatagcacttcatattcatcagcccaaaccatccatatgttgaaatgcttcctttcaatccaaagaaaagcccacaaatacactccacccacagtattgactctacctagcccataccacattaataaatgacacctcctctaaaatattataatgctaatggtgaaaagagatgaacatttagaaaaagcaatggatatttatatgagggagaggaatattttgtattttattctgtacctctaagcaggtaataaggtacttttttcctacctgtgaatgttccaggtgctggcatatgaagacataccaagaggggactcttccccttcctttcttttctacctcaagccttactctggaggcctttggagaaataatatcatgccaaagttaggaa

SEQ ID NO: 2079 - DNA, 344 bp, Homo sapiens
aaaagtagattcattgtacagtactgtttagaaggttttatgcttcatttattaagaaatgcattgcttctatagaactagaacttataacaaaactgaacttgagtctatttcaattattaagaattatcttaagatttaaagaaccatctgagggtatttatccagtgcaactacagtccaagttttttccaaatgctaatgttggcccaagtctactgatgtactttccttgatattgttgctctgttagagcaaaaagataaagttggtctcaaagctaccaaggctcagaccattctctgtgagcgcagggatgaaataataatgacgaacacccactg

SEQ ID NO: 2080 - DNA, 1979 bp, Homo sapiens
cttaacccccacaccatactgcctctcaggagagcaggatggaaaaatgcaacaataaaaaccaaagccgggcaataaggcctgaaaggagaggacatggaatccagaaccacaaatccttttcccaaacactgctaggagctctttctttgcagaaacagtgacaggagaagagggaggaaaggagggatgtggcgggggtgaagggaggggagaagagtatagcaactcccttctcttaacagtgatgcaacttcccttcccataaattagtggcctgtattggcacatatgaaaaaagataggaactttgcaatgtgtatctaacatcctgtatccagcagagagccctacagcaagtcagcaaaaacagcactctgccaaaaatgaatgttcactgcttccaaaaatctattttagaagtaaacagtgtttaaatttgctggaaatgatattctttgctgtgactgctccagaacatggcattctgtcataccagaggagaactgaggaatttcctcccgctgacacggctgactttgtcttcatgccttttctcagggcatgggaagaagtccctgtgacctaccagcctgaaaattctgccaagaggctgagagtcatgggaatctgcccaaccagctttgtggaggtcactgaacaccatctagacattaaaagaggaagccagacacaatatagtttcaaaggactgtgacagtaaatgtcttaaccactgatattattaccttgagttgtgattacctagagacctattcatcaacattgatgaaaaggttgagtcttccaatagcccattacattctctattcttagttacctcttcctgaaggaaaattgtccatgtgaatgaagcattactgatgtctagtaaaaatgaaaacttcatccagtgggcaacggaccacatgggcacattctccgcacacttacacactcacatcattagtaacaggaaagggaacccaagtcaaagccaacatttgaaaggaagagataacacagccaccaataatgccattacagtggccaacagattttctttaggaaatcccagatattctaaaaccaacactcttttacacgataggaatacgttttctaaatactgtctttaaattatttttaaaaatcgtcttttaaatgaaatttttaagctattttttaaaagttgtcatttatatggattaagatatcagaagttcacagagagagagcaggggaagacacagagagaaacagagtcccctcccccaccaaaaaggtaaaataaaccatcaaaatggtagctgaagtttaaaaataagattccaacctcaggaacctatttctatgactacatacagggactccagatggaattctaggttaccatatgtagacagaaattacagcaggatgaagcacagcattttgatgccaaactggaaacaccactatttttttcatttcaagtaatttgtgaaacagacatccctaaactttaatccatccctgggattcatcctttccatgaccctcaccccatctatcacacttacctgtctatcactcctatcctacctctaaaatatgccctaggggtgggagtcacaagacctcggagaaggggtgaggatatcctttttgcaccttctctgtactttcaaataattaaaacattggaggttcaacagtgctatgtcagaatgttcctgcacaaaaattgctgagtcaaaataactgggtccaaaagtcccgcaccaagagatgtaaaaatatcaagatacaaagatataaacatcagtaacataaaacaggaggcatgagacactatggagcagacttgaggagcaatctctggtgctcatcaacgcaacacacatcttctagatgtgagttttagttaaacagcataggatgcagaggttgtacagggaataaatgagaaaataggaattaggcttatcctctaagag

SEQ ID NO: 2081 - DNA, 515 bp, Homo sapiens
taatgggaggcacttaataaataattattaatgaatgagtaaattcatgtatgtcccctagatgttcctaggttttccaaattaaggaataaactggtctttgactgaaaataacaacaagggttcttataactctctaaagtggtgtttggaggcaggccttggggatttgctacctcaggccaaacaaaacacttcaatctccccagctatccattaacaccttatttcagtgtggaaattcccttcacgagtaaatgctgagtataaatagtcttttctcaactcctaggaaaagggaaaaaaagatttttctaataacaaacaaaatgatattagaataatctcatactaattgataatcaagtatatagcaagattgtttctaataacaaaatgatattagaataatctcataccaattgataatcatgtatatagcaggattgtttctaataacaaacaaaatgatattagaataatcgcacaccaattgataatcatgtgtatagcaa

SEQ ID NO: 2082 - DNA, 429 bp, Homo sapiens
agtgtgtgattgttgttagatgttatattaagtacaaaatattacgaatccagtaggtaaaacctctcatctttactggagaaatcgagatagtctttgaaaagaaagagacaatataagggacctctccaggaaagtgtaaaagttttccagacagaccagagggagaggaaagcattccagaaaaaagaaaaagtttgtacaccaggcacagttatccaagattttcacgttcaggagcagtctgctcaaggcctttagactccagcttccagggcagtaccaggagatgcgggtggagagaatgggaatgacttctcaagttgagttgagactggagacaacaggaatggtaatgacttctcaagaggagttgggatttattttgaataaaattgaaatccctcaggtgtttcttaagtacaggtt

SEQ ID NO: 2083 - DNA, 305 bp, Homo sapiens
gatttgacataaacggatgtgtttgtttgtagtttatttgttttccagaaagtaactttcatagtgttttgaaaaatggagtggatatgggaaacgtggtataagaaaagagtgagaagggagttgttggaaacttctaaaggagagatgaggaggaaagggaagaaatgacaggaagatcccaggaatgtttcacaatggaatttacgggatttgacagttagttggatgtgagaagtaaaagaaagggagaaaccagggataatattaaagtatggtgaagctggctgggcacggtgtctcac

SEQ ID NO: 2084 - DNA, 476 bp, Homo sapiens
gtctgtggaccgtggaaaagacctctagttagtcagcagcatggatccttggctcagaagatatttcattatttgtgacacagactctagaataattttcttaagatagatctcatttgaacaaactagattgcccagagattgctgattatgtgaatggtgctatccatataaaatattatgggggagtagctgtagactaaataaatactgtgaaaatagtgtaacttgacattaatatttaccaatgtccctcttgatttttctgcctataaaatagaaaaaatagtatttgtgtaaataactttaaacatttcgtttttaaacgttctacctcatgaatggataacatagttgtgcagactcaaaagaggttgaacaataatcccacttccctgcaaaaaaaaaaaaaaagataaattgatcagagtcatctgatggtatggccacattttggctccctgcttccataactc

SEQ ID NO: 2085 - DNA, 29 bp, Homo sapiens
ttccatattaacacatgaattctatccct

SEQ ID NO: 2086 - DNA, 109 bp, Homo sapiens
gatccttacccctttcccttcctattgttttctttcttacagcatttaaacacactctaatgcctcattgtaagataccatatctcaacccataaccctacccaactac

SEQ ID NO: 2087 - DNA, 250 bp, Homo sapiens
ttgcttttagaagactctattttaccatttttatttctttatccctactaagtccatcttgccctgcaataggaaggaaggaagaagggatagaattcatgtgagtaagaattgtcaaagcagggagactttttatttctttatcccagctaagtcccagtcccactacaatctggcttctgtgtccatcacttcgatctcaataaaaccaaaaagcctatggtattaagaaagccaacggatacttttc

SEQ ID NO: 2088 - DNA, 193 bp, Homo sapiens
cctcttttttttatagataatgttttattgacttgatttctcagacatcacattcttctggtgtcttccaacctccgtggcctctcagtttccctcttccctccaaaatccatagtcttctcccagctcttacatgttaactttcctcaagactcttgaaaaccctcctcctttttgccttacacaccatctc

SEQ ID NO: 2089 - DNA, 114 bp, Homo sapiens
gtggtgctacacttaagaaaacctgtagcttgccttcacatcatagcccacaccttataacatacctggcatacaccaggtgtgtaaacaaagcttgctgaatgtagagtgaga

SEQ ID NO: 2090 - DNA, 57 bp, Homo sapiens
ataacaaagattgtgtgagccaaaaaaaaaaaaaaaaggataatcttgtctagaagc

SEQ ID NO: 2091 - DNA, 116 bp, Homo sapiens
ggaaatcaatcatatcaatgtcccattgaaatgaaaaaggaaaattgttagcctggagatggggtagaaaggagattcagaaaaacatattaactggcttcatacttaaatatcta

SEQ ID NO: 2092 - DNA, 223 bp, Homo sapiens
gagccaccacacctagccaagatctataattctaaaaataatacatggtcttcattctcaggcagcatacaactcaatgcagagaacaagacaaatatagcataattcagtgaagatggagatgtaataaaatagattttaaaattatcaaaataattaaatgaatggtacttagagcagtaggccctcacaccacctttaaaggtaagtaactctgctacct

SEQ ID NO: 2093 - DNA, 100 bp, Homo sapiens
ggggtatacagaccttggttctaccctttatgatctaaaacagctgaaagtattgacataaggatactaaaaactaaatagaggctgggtgtggtggctc

SEQ ID NO: 2094 - DNA, 67 bp, Homo sapiens
ctaaataatttattgacattacagatataatttaattttaactactaagagcacaatcagaacaatt

SEQ ID NO: 2095 - DNA, 667 bp, Homo sapiens
agcactacactgtagagaaggcaagcctcgcctctgttgaggctattctgagatctcagggtgcccagctctgaagtggagcagggataaatccatggttctggacatgacatgtatttcatgtaagtctgattgacaattaaggattttgtgttcatttgatttaaaagtcacagaaaaatccaaccttcaattgtcttcacacaaaggaatgactctaattgcacatctgactggaaaactgtaaagctgggatatggcactcttgccgctgtgtggacgcgggcaccctggagctggttctccactctgcgattacctggctctcttcggattctactaagcgtggaagaagttacttagagcgaatactttacatttactagtaagatagctgcacaggctgggacttttctgacaacagtaatgattatcattagttattttaatagtttaaatagtgccttggagagtaagaagatctactgttaagggaagaaaaaacacagctgagttgtcttattaatgaattgagctgctcattagctaattttttccacagtctttaatgatctcctggttaatggctgctagaaatacagaagcactttaataagggctctcagtctaaaacatttgcagctgtaacattgactactctgcacat

SEQ ID NO: 2096 - DNA, 518 bp, Homo sapiens
atgtgggaacagagaatacctttatctgaaaagacaaacagccttaattcatttggctacctaacgggtttctaactcaagttacacataaatttattaaatcgggtcaactgatgtaattagccaactgttaaaaattgtgcagacggagagagccggtggatcccgatggtcatgacttatgagaaggcatacatcacaccttgcctctatggggaagaaaattcatttttcacagagagtgtaagtctccatcctgaggtaatagagaagagagtttgtgggtgtcttgttgttattgttgtttctgtccttaatcttcccaccttgcatttaaaaactcaataaaaaaaaaaacagtgactataagtcaccatgttctttgttatggaagagacaatgtcttacaagcccttaaagttgaagtctctgatgccctccagcagttgactggggatacctggttacttgtcagctcctaaccgggacacagagtaggtcagagaagtcgacccggg

SEQ ID NO: 2097 - DNA, 888 bp, Homo sapiens
tccaacgcgatgatacatacgatgtactggtgtgcaacgggtatccagtggatggcagctatgatttttgtgtttattattaataatgggagtacaacttgggcaggttcatctcggtgatatgaagcttcggtttcctctgcctaagatttgttgaccctcctgccaaccaggacttgaaccttgcccaaatttctgtgtatcttttttaagctttgccaaactccccccacaccccctactcccatccagaggctggatctgccttttacccctgtcaacaataccgttgcccactcccctcttcccacctgccccccctccccagccactggttgtatttctgtcatggacaaaatcatcaaaatgatgctgatgccacttgctttttagaatcagcggacacagtgacttccttccgtatccctgccccacttatcagctgagcacctcggatctcagaaattgcctcagcggggcactaggcttgactgttgtacaatgaagcactgagctgccacagctggggcaccattgtactacgacggtgtgtttcccaggctccctccccagcttctgtctccttcctgttggcttcggtcctggcgtgcctcacatatgagcactttgtgttaggctacgcaaagaaataagaacagcaaccgcatcaaaggaggttacaatttacctttcaacacaatcatcatctactcctaatttccccacttgggcgattagtataaaacttattattttactactttttatgtatcagtagaattctattaataaatgccagtaaagcatacaattcagtaatacaaaccttgttttatcctatcttatgttggctggctggtgtagatcacaccactgaactccagcctg

SEQ ID NO: 2098 - DNA, 744 bp, Homo sapiens
aagtctcacagcgattgttaatcataatttgtaattattaattagataactccagaaatatacatgaacttggtgataatttactctgataatacatcatacaaagataatataaattctgccagaatactctgtggcttcttctgcttcccaaatgtcctacataaaactattaatacttgtaaaagacttcagtgaagaatgaatttcccccagctgagcaagcgtaatttggctatggccagatgaaggagcgttctgaagcaattcttggcatggaagcaaatggaaaggccttatgcataggcaaccaagaaaaaaaaatctaaacaatttaagatgcagtgacttcccaggtgcaggtgcatcagtcacatactccatctaccatcggcatgtcttgcttttgtaacaagagtctctttctataatacgggcagttggtcttgtactcagctgggcattcagcatggctcctgtctcagcaaacggagtcggaggggttagctctggtgtaggatgcctgcctgggtggcaatccctattggacaggtgaaaatagatcattattttaaagtcttgatccggccttagaggttcccctgtgtttcctgttctgctagagctgacagctaggactcctcaagctgtgcacgattgctttctgcactgtgtgtggctggagcctctaggttagcaatgtatctactcactccagaacggtcttttcataaagaaaacctg

SEQ ID NO: 2099 - DNA, 25 bp, Homo sapiens
cctgatatgttaaatcactttaaat

SEQ ID NO: 2100 - DNA, 341 bp, Homo sapiens
ctttcaatgcttctcggtgctcttaggataaagacccaggttcttcccatggactctgcacccgatacagcctggcccgcactccctctccagcccctctcctaccgcatgccgctgcccccggccttgtgtcctccagcatggtgacctcctctcagtgtccagggttccctacccccacaaggcctttaccatctcttctagaactccgctctgccttccagttgtgcctccactgtcacttcatctggaagctgtttctgccctttcagaccaactgggtgaaattgctatgtgtgctttcttatgccatgtgtcactcctccatgccactggccaca

SEQ ID NO: 2101 - DNA, 214 bp, Homo sapiens
cactcagcacgtttcaatatgacacgtatctgtgcaatgacgccgttcatatgtgcctcatctcacaaactcgaagcgtcatcaagccagagacaatgttgactttgttcttcatagcatttccagggcaagcatggctcctaggataaagcaagtccccactgacacatttcattaaaagcagagaagggttagaagttcatcagccttggct

SEQ ID NO: 2102 - DNA, 1570 bp, Homo sapiens
ccagaggagccaggtcatccccagtcagcacctcccaggtcaggtcctatttctccaattgctcagctttctacagctgcgcccactgtgggctgctcaccctcagagcccaggacaggtcctattcctcgaatggctccccgaatggctcagctttctacagctgcgcctgccgtgagccgctcaccctcagagccctcatgtctgcagctgatttttgtttgcagttggcccacttctgttccttattctgcctggaaccctgcaagtcattgatccctcattcaacctgctcctgggtgctcagcacaggctcagtggggggcctggctccagtccaggtcaccctgtgtaagcaccaaccttgacacttcataattaatgttgttgccaggaagctctgataaagccattcacaagcccaggtgatggtggaggaaatgtcattcttcctataaatgcttcccacatctcacttattttcatgacagggagctttttgctgtcaggtttttgcctcagacagaaattcatcgctttcagcgcattatccctatatcaacccttctgtcactgttgctttgcattgctgcattaataataataaaaaggaactcatgtttatcaagaaaaaacttcagagggatacattgaaaaaaacataaaaaatgctcagagattgagattgcttcttcaaagctctggacagacgaaaaacacattggttatttacatatcgacaggttcttcggtaaggtcaagagtacatcatttccaactaaatgttctaagatattaactgtcttttttacccatgtgaatatcataggaccgccaagtgaggcccaaagctatccgtttttagaaatgtatttgtagtgatagtcctggcacagctcaaatatatcctgaacttgacctgaattgtaaattaattcttaacgctttttgcaaaacaatcccctgcctttgggagatgggagaatgggtgctcctaaatcactcgatcatcacgagatttgctgtttgcaaaccggggcagactgccatctttacagactaccgaggaagaaacccaggaaagggcttattgtttttgagatttatttcaatcaagatctgaacccctgaggcctttgttaattttcctctgactcttcatgtatttcacccttgccttctttttgatttcccatctgtcttgctctttttagtttcctatcgaattttgtttgttttgtacactaattctttcttctatatgtgtctttgatttgtcccctaagtcctgacctgtttcaggctgtattctctattactttcatcctgggacactttcctttgagttgccctgatgggtgaactcagaccacagaaggtcaagctcagacacatcttgtggtagataatctactggttacaatttttttttttaatggttcctacttagaaactcagtcctccagcactcatacacataaactctcagttactttttcaacaaaagttttcttagtggtgaattcattttaccaagaagtattcagtatgtcacataaatttgcagatg

SEQ ID NO: 2103 - DNA, 159 bp, Homo sapiens
ccaatagtacaacataaattcaatagtactataaatcacatttcaacttaatactattctgatgggtatagatcgccattattgatgagtagattatctaactcaacacttctcataggtgttgtcatgaaatgctggtgagtgagtcatagtacaaaa

SEQ ID NO: 2104 - DNA, 167 bp, Homo sapiens
cggcatgtgtggtcaccttagcgacaaccatcctgaagtgcgctacagatcacttgaaaaataaccacaaaactgacatgcaaatgaggcgggttcgacgagattgctcatttacaacccagcatgctttcctgagtgaaggaaaattattacaaatatttttgggg

SEQ ID NO: 2105 - DNA, 1491 bp, Homo sapiens
aatatgtttggtttttaagttataaatattcctcggtagctttatatgaaccttcttacaaagtgccagcattatgggggccaataccttaaagttaagagcagatgagctagacaaagttaaccggaatttaatttttaggaaattcaaagtgaatgtctgtgaaaactagggtttataatttgcactagttcacaagttctctttcctgaattcccagggaagccagactcccacttaccaccttttgaatcttgaaacaccctcttcctcctcatccaggaccaaggtttcctagaaagctctatcatttttccagattaacttgaaatagacaatgtccatctgagatcatttcaatcttaaaactctggcttcaaactaaggttcaggtaatagtcttgcacctgagtcacttctaattcatttggtccccagttctgataggtaagaactggatggaaggtgccctctgttgggccagccctatgcgatcttcctctccctcaaactcccttcacgtggtctccaccgcccagttccatgagcagaacccaggagcagagcatggggttctttagatatgtcaccaagggacgtgccacttggggttaggaagtgacaaatctgtaagcagcaggaatttcttttccctccaatttttcacgcagtatctggagaagcaaagatctagatctgggcccagggcaaaataatatgtctagttttgggagttgtgtcctacctttctcaaaaaagaagtgcaaggatttgactggtcctaggcttccagagggaatttacaacaaacccagagagaagcagggccttggggcctgaaggagaattatcggcagcacacaatctataggagtaaagaaagtgtgacacatgcatctaggtataattttctggcaaatgatttctttctggtatgaaattgttgtaaattatgaatattgttaaaagggggaatcataatgcacttatgctggctctattcccagaaatagtataatatataatatatgttgtggaagggttcagaaacaccagtgttatatttctagttatatacttccacgtattattctagtagtttcatgcattttgatttttttaacctacaagtggatcagagcccctgggaggaggaaccacatttcattcaccactgggcaacaaagaaaagccagactgagactctgcacatgcacatggtcactgcccttccatagctttcagtccggtcatttcatagagttgtctactatgcaaataatcatctactataagactatacattgaggatatgctaaagaatatcaggtaactgtctaaaaagatatatatgcaattttttagtgcaatgagtattctaagattcagcagtgtatgctgttcacaatgttcatggcaaaagttagagagtgtgataattccctacagcactcatactaaagtgccaggcatcaaaataaaaaggtaaag

SEQ ID NO: 2106 - DNA, 228 bp, Homo sapiens
aattcaacctgtgacagatggtgttgctcttccgttagttgacatcctgggaaccatcgccttctcccatttatcttaatattctggtccaagatcaagaaatggctgaacaacaggaaaatatgaaaaaaatggtagctaaactaggaaaagaaattttagtaaataataatcatcctggaaatgaaggtaaactgtaagttgctcaaaagagaattaaatattgct

SEQ ID NO: 2107 - DNA, 22 bp, Homo sapiens
aggtgtgtgaacaatatcttca

SEQ ID NO: 2108 - DNA, 150 bp, Homo sapiens
tatatatatatatatataatcaaagccaataaaccaagcagtgggaacctaagtagggaaaaggaaattaagaattttattcaaggtattaacaggaaggttaccatcaaaaagtgaatacaaaacacacctactataattttattttga

SEQ ID NO: 2109 - DNA, 240 bp, Homo sapiens
ttctgggatgatggagcggtggtgcatcccgattgtggcaacctatgcatgtgttagaatttatagaactgtacaccaaacacaaagtcaatgttactgttgtatttgtctattataaatattatttgaaaacacaacaaaagcatacttgtcaagtaactgaataaataaatgaatagacaaccctcctccaacctctaccagaaagagcaaaggcaataaatgacaaggtgaaaaaca

SEQ ID NO: 2110 - DNA, 142 bp, Homo sapiens
tcacagatcctaagggatgacgatattgccttactgtcctgctgttcttgtttcaagcttcttaaacacagagtttcttctcattgtgaatatgtcttcatggaccattcacttactaactccgatgacttctattcttaac

SEQ ID NO: 2111 - DNA, 4 bp, Homo sapiens
ttaa

SEQ ID NO: 2112 - DNA, 593 bp, Homo sapiens
ctggtaatctgacttatcataattcatttataaactaagatcatgacctgcatctctaaataaatattattcatctatattaaagtaataaacagaaaacttgaatcaaagatatgtgaaacttaaagtctcatcctcctcatctacccagtcatctctactttcaactaatcccaatctccaatcttgatcaactaaatatctaattttatgaattcttactagaattcaccatctccagttttaattctctctttttcccgaaattcctgaatgtcacacctaaaatccaggctcaaaatccttagttggttccctgtcctctaaagagcaatgccatgcatttaatgaactttttaaaaggtccaccacatgccagttaccttgatacatgttgtgtaaacaagaatctcctaacctgggaatcatgatcatttaaacgaaggaatgggcagcaaaactaggacacgtagagtaacagacataatgggtggagtcagagaagtaataggtaagcctgtgagattaaatgctgctgtattcagtcttaaatgatgaacaagaacgaactagttaaagaagaggataggaag

SEQ ID NO: 2113 - DNA, 29 bp, Homo sapiens
ggaatgaaaggaaggaacgaagcaaggat

SEQ ID NO: 2114 - DNA, 144 bp, Homo sapiens
aaaaaaagagaagagggcagagaagtgagtgtacaaaagagagaatgcaaaagatgaaactgaaaagtgaagagtaagcttaccatactcagcaaaagagcttgtattttctctgctagattgatggttctcaaattgtatcat

SEQ ID NO: 2115 - DNA, 408 bp, Homo sapiens
agtatccatatgagggaatccacatcttttaaattgaccatgggtggctttgatattgagacacccacgaattctacaaatgctcctagagatactgaggagtcatgagaagtttctcagcaaggagcaagcacatgtaaacgtcagattggcttttaacgaagctccctagaaagcatgtgaaggattaatatgaagagggtaagtccaagtcagggataccatcagggacacagagggagaccaggaaagaatgactgactcaagtaatgcaggcaaggatggtcacagagtacatgacatacagcaatgggaaatgaaataagaagttggagaacaacgcctacctatttcttatatattggtagcgagagagagagagcagggcaatggccgggtatctatttc

SEQ ID NO: 2116 - DNA, 21 bp, Homo sapiens
aggtatgtagattaaggtata

SEQ ID NO: 2117 - DNA, 115 bp, Homo sapiens
ccaaaaacctagcaggctacacagaagatactttgcaatctgactcctgactacttattgagcttatttttaaccgctgtcttctacatatcttgttataaaatatatttgtgat

SEQ ID NO: 2118 - DNA, 403 bp, Homo sapiens
cggtggttaacaacccattgcattctataccccagccaaaccaaccacatgtggaacttaaatattcatgtggcacagatgtttagctttggttcatttgattgctctgcctgaaatatttttcctagcattagcacattagcactcaatatttctttcttttttacgtccctgtaaaattcttgatcttcaactatgcggagcaaaaaaacaggcacttgataattatttattggataaataaaatatctagcttctgaaaatcgattgatagagccgctactaagtttcagtttttagagtaacataaaagtcatgtcaaataaattccaccctcatgacactaataatgaagaaaaagaacatcaaaaccaataaggacaaagagagagagagagagaga

SEQ ID NO: 2119 - DNA, 1188 bp, Homo sapiens
ataaactagatcacatatgtattacagtgaaaagggcagttatttcaaagaaaccttaattttgtagtgacatgaaatattaaacttacatacaaatacagagaatatgattatgaaaataatttatagaacaaattaaacaataacattttctaataaaatgaacaaattaataaaatatacatgtatacatttaagtcctagtgggaaaacatgcacttaatgaaaacaacaagtagaagaccaaattaagcaaaggtgatggcacaaagagctgaccacaaggatttataatgttccaagactgtaaaattaagtgcttctccccatctagacatattacaaatattacacagtaacaaataacacagcagatggtttcccctatgaaaattagaaagaatgatttaaaatttaaaactacaaaataacacatagcaagctcagaatagatactaagaataaaagagatccaataattaaagaatgaattctgactaatgaaactaaaataagataaacatagcaattcaagacagcatacctgccagtgaaataatcagaaacaaaaataaatccaagtgtgcaattagtgtgtcttcccaaataccagccaacaatccatttctgtaaaacgagtaattctgtagaatctcttgattaatttcaagcttaattttaaaatatagcaaagtgtaggaagacaaaccattacctatagtttggcaggaagaggaaaggaagcaagactctagacccaaagatcatgatagagctgtactggcctttaggccaattttaatctcactagtgtgatttaatgttcatagtgatgcctgcctttgaatgcttgttagtatccaaaaccaggttccctgtaaatttaaaaccaccacaaaaaatacaataattgattttgtaaatgaaagtgggcctaagtgccatattcttgcaatgatattacagcatacaatttacagaaaaattggattaagttgggattgaaatgggatgagggaaataaggcaatatcagtgaatctttcattggacagaaaacggagttccttatcaactgacttggattttcatcccctggtgccctaatttaacgtgaaaagtcatggataaaagctggaaaaaggaaagagatcataattaaaagccttttatggtcagtcattaatac

SEQ ID NO: 2120 - DNA, 233 bp, Homo sapiens
ttatttctcttgtccatagaaatttatctttcacataataaaaatagccttcatttctctattgctcgaaacactagttccctcatttacaagatccaaataagaatgaataatctcttaagatttttatgtgacatatcttagtagatacaaagacatataagagaatttcaccatcaagtgtatatttgtgcttgtgtattagttgttccaactagctactctcacctgaa

SEQ ID NO: 2121 - DNA, 320 bp, Homo sapiens
acaagcacatgttaaaaataaaattacctggagatcatctcttaaaaagaaaattatcttttgagctgatggaacacttgcttaaattcctgtatcttagcattacactggacactatgggattggtaaaaccagattctgtgcctcttgcacataagggaaatacaaaaatgatcaagaagctggagctgggatcatcttgagataggcttagattgagaaataaatactaatttcaaatataaccttcaagctctattgaatgaattaatcataattccttagcaaataaaagtttggcaatctgagagcacctactg

SEQ ID NO: 2122 - DNA, 86 bp, Homo sapiens
catagtgaccataatatcacttttgtattatatgtgccaatttataatcatttatgtttatttttttctcaaagatgagatagttg

SEQ ID NO: 2123 - DNA, 2307 bp, Homo sapiens
aaatacatttctgatcaacattttccaaactatcaagcagttcaacctggagtagaaaatatgtctctagttctctctcctgtcaaccattcagaatatctgcatctaatcactgcttcattctcaaagaaacactatttgcccagataccaaagtaagtctatctagagtttgaagggctcagctttattttaattacattagaaagattatgctgtgttacccaagggcttacatctacacgcaagacctacattctagatctgaaacaataaagcaacataattgccatgtactatatcacatttaatatactgtagatacatcacctcaaaaatacatcctagctctgcttacaagcctgttatgtaaagtgtcagtgaccaaaagcaacagatgaaacccagtattaaaagatgcttcatcagatacttgtgtaagtatacacagagatatacatttataatctatacatatgcatgtttatgtatatatgttatagatgacatataacacacattttacatactagcacttctgaagttatcagaaattttcaaaacaagtaagaatattttaaaaacaagaatatttcagaagttcggtgtacccaaacaattaaatacaaatcacttaaaaatactgcttgctcaggtttcttaatgtcataaattttgaatacgacaaatttaagctttctctgcccttttttccatttcaattatatccattgttaaatatagtaaattcaatttctattccattgtttaaaattcttgaatgtttatggctcatggtgaggagtggtttggcttattcttttatgtagtgtaaagtaggaataatcactttcaccctttgatttactatatttttataatcacttgtaaaacgtgatacaatgggatgtaaaactataattttaagagtagacagatgagtaataggagttgacttcctggtttttcactacattgtaattaagaattcctggaaggtagcttagggggacagttttaaaaaagatttatgatgtacttttaaaaatcttgagcacggacaaaggtttatctttgaagttttgggatataattacagcataaatagacttctggttcatattgctcttacaagagcatttcctctttgcagacttaggtttctggctactctagtcattgttctgagggagtcacaacaaaaattaataaaagttaatcatacgtttcccttaatttctagaataatatctgatattctttaattttacactcacttccaaagaaagcctcactggtaatagaaggctggcttatgctgggatctcagctctgccccttccatttcaccttgcatggatacactgatgaactaacatggatgcagccaaaacatgttttataacagaaattaagtcttgcaggaagaaaatgtacttttgtctaataaacaaataacaatctactgtttatgaaatctgtttattttactcagaacatgtaaatacttggagcccagtatcttagattaggagaatataccaccaccatgacttaaaaataaaaatggaccaaaaagagattactgatagacttttaaagagatgtttaaaatgcatgccttgttaagtgacacctgtctttcacatctttgtaatgtaaaaaataaaaccactgtttttatacatgttgatttttagccagattttcttacattagcacctaattctaatcataaaacacacatttgctaacaaatgagtgagattacataatataaaatgcatgccaaaaatgcaaacaaaagaaaatccaaggatacaaagagtttactttagcaatctacacctggagaaagggaacataaaggtttaagggtttcatctcttaagatgaatgagataaagattgtttcacctgaatttgcatctttcaattcacctcaatgtctagagacattgagggccccccactcactagtcctcatggttgaaaagaatcttcgagggagttgggaccttcagacttgtgtgtcaaatctcagtcggtgggtggagctcttgccaggcctctgggtgtgggcatctcaagatggatgtggtggttacctataagcaggcatgtgctaggcattcctggctgtgactgggggtccttcacctgggatgaagtggccctaacctcttggattgagcctccatgctggctagggcttgtgtcctgaagcagatgcccccacactccaggtcaccaaacatgtccagtccttcctactgtctcctccagtgttatataaaagcagcagctt

SEQ ID NO: 2124 - DNA, 53 bp, Homo sapiens
gcagcagctttcctttatatctcatttaacaaaacaaagcttagctttaaggc

SEQ ID NO: 2125 - DNA, 120 bp, Homo sapiens
gagatttatgatgcattatcacattattctaattacctagagtagttggtgtcaatatataatactttgtgaaaggcaatttactagataatttacctcctttatttatgctcatttgtg

SEQ ID NO: 2126 - DNA, 383 bp, Homo sapiens
caatctagaaatgccaaattagaattagaatatttatataaatgataatagctgccaattagtaaaacagaagtatggcattttttcttattctaagtaatacaaagaacaaacttggcactaggaaattgtcatcacaacattggacaaaataacctatgtggcaaaatgttagtagaactgtgatgatatcttacctctgcttctgcaaacacccaatcctttcaatgacctctttcccatccagtaattctgtgttgacttctggctacctaaacctaccatacatttaattattcccatccaagccagttatctcttaatatgacttgtgcttgaaattatagttcaatagacttatgtaacaatcagacaagtgcaag

SEQ ID NO: 2127 - DNA, 260 bp, Homo sapiens
cagacaagaaattcctaaaataaagtgaaatttgctttttataaaaagccattccacaagttcatctacctaaacttctctaaagttgggacaaacagaattctctcttagcattgcaaatattatggccagaaaataaacttcagaggagaaagtaaccaaacaagtgagccagaaatacaaacacatttgggagagtgtaatttacatctgtataattataagtacatgtcactcagtgaactactactatattttcc

SEQ ID NO: 2128 - DNA, 97 bp, Homo sapiens
aataggaaagatataaaacattagatataatatgatctcatgtatacacacatgtatttccacaaatatccacatacaaatacattccaatgttaac

SEQ ID NO: 2129 - DNA, 82 bp, Homo sapiens
taccacagccctagaaaacaattatattttgtggtttttaactttttaaaattctgtaatgattgtagactcacaaagttgc

SEQ ID NO: 2130 - DNA, 539 bp, Homo sapiens
gtttcagacttcattcatatttttgtgtctttctgaacacaaatatttatctagtacttattcttccataacctatttcttccgagatgctgcctttatttccccatatttcatgtcccacagccaatcccttgccttttctacttccacagcaagtctgaaattccagaattctagaccagctcagagcccagagtccttcttactgactgggaaagaagtttggacaactttcagaacatgccatgatcagtcattcacatttctgtatctttgctcagttggggtcccctatggagtagggaactagctgaagttctagctgtagccacatcacttggcctgaacttcttcccagagacatcaaagttaccaaggccacactactcccttcttcctctaaattccaaaaacatttgtctgcacctatgatccaggcactaaatcctaggaacctttgatttgtggtggcaatacaatggttcataactaactaaggacctacataatggttttatgttttaagttttaattttgaa

SEQ ID NO: 2131 - DNA, 37 bp, Homo sapiens
gagagagagagatttcactcatttttccactaatatt

SEQ ID NO: 2132 - DNA, 98 bp, Homo sapiens
ctgtgagaaatacatttttgttgtttataagccacctagtgtattttgctagagtagcccaaggattaatgcatgttattttcctcctctgggatcca

SEQ ID NO: 2133 - DNA, 182 bp, Homo sapiens
acatataacaggtgtatgttagtaaatgtttatttatgtgaaaaaagtaaaccctcattaagccactgcagtaggatttcctattaattgagccttctttgaactgtctttataatgcagtccattgtaacaggattttaatctaaatataatggcaaaattaaataaatagaacactgctt

SEQ ID NO: 2134 - DNA, 249 bp, Homo sapiens
atgcttcttttctttgtaaaatgaaactgaaatgccaatattcatatttctcccaattatgcctaaccatgctacctactccctactgctctgtttgaacgttatgtgaacttgctgttatggccaaataagtcagccaagatgggaacattaatttctttgagcagatggttgtaaaggttgacctgtaaaaagaggtgccaatttgttttgctgtagtgtgctgtcacagaaaaaggactctgttag

SEQ ID NO: 2135 - DNA, 185 bp, Homo sapiens
ctgtaagccaaagtcctgacaaatacagatgctttctgagcatctgctacctaattcttccattagagattcattcctttggctctagaatagcattttccacattttgtccagcagaacacttccgttagatgccaacaggcgctccttggtcaaatgaggaggcaggtgctcagggctcttca

SEQ ID NO: 2136 - DNA, 934 bp, Homo sapiens
atcataagatcggtgcataacttatttacatatctacaaaaaaaatctaaaagaaaaagttctcatgtcatcagcctgacccacacataaagcactttggctatagaatcacagttaagtgagtgataaataccgccacgggagtatttggagcattgaagatgtgagggacagtatttccagcagagaaaatggctggggcaagggtacaacactgagaaattgccacaagctcaacatgtattttgaagttctgtaggacatccacagtgactgaagggttgagttttggtgtaaaaggaagatttcggggacaaaaaccaaacaagaactagagaaaagttttgtttggaacagattgtggaggttctgattggcagtctgagtgatttgattggcagcaagatcaggtaaccctgtgaggaggccaatgccgtggtctggtcaaaccttactgcaggactgggaaggactgggtggaaaaagaaggctggaggtggttggaatcccagcctccgagaacattctgcagagaaactttggccatatttgctcaagaatcttcctcgtggtatcatttgaaagccatactttttatttcatgctaaacattgtcagagggagcggtggcagattcatcccggaatgtgagccaacgcaccgggcatgcactttaaatggcattccagacctcgggctggcaggctccctcagatcctcgccctgcactggttcctgccttaccctgagttaggatgtcaggagagagggtctgttttcttaccttcccagcagagaacatccagaatgagacaccaaccctccctatttcacctcgtagagatatcactgcacgggcgtcagcctcggtgctgttctgatgatgcattttctcttcttctctcctgtcctccttatgcctgatctttgggta

SEQ ID NO: 2137 - DNA, 91 bp, Homo sapiens
atcattttgggcctctctgcttgcttttttccccatctctacgggactgctctcttcatggcccataatgcacctcttcacaatagaagct

SEQ ID NO: 2138 - DNA, 112 bp, Homo sapiens
actgtgccatggcagggtcagccaggtggagtgagggtagaggatggtggagagtgaggctgagggaggagggttggtcatctcagctcaagctcagggggaaatgagaaca

SEQ ID NO: 2139 - DNA, 238 bp, Homo sapiens
attaaaaaatgtttaaaaaaaagaaatgtgaacatgcctgtgtttaatgctcactggcccagtctgatgtgccatgtgtgaaagaaatgatgtgtgaaagagaacttggccatttgtcgagtccttctggccaagtgtgcctttccacaaatggtgggttgggaagatccccctggccagaaagaattctgatgtgtgtaattgttccgttacagattcattcctttggctctagaat

SEQ ID NO: 2140 - DNA, 481 bp, Homo sapiens
tgtgtgatgtcgttgctgctccgtgagaggggactgaagtatgtgacatttctcccatgtttaagatcaaggaattccagcctacacagatgcttcctagggttccaccgggcagcttgggaaacgcttgcagcttgggaaacagccttgcagtcctactgagtctcctgtgggaagcaaatgttcctggtaggccagtctgtaggagaatgagatcagtgcagacaaggccttgaaagcatgggctcgagaggggctgcagaggcggtgggtctgaaaggggggggtggatgtgaagatccaaagtgatccttttcccaaggagcttggagcctggcagagcagagctccctggtcccccacctcatggctgcctttctccatgggaggcctctctcccctctcattcctcccagtgaagcttagccgccctgccatccagagctctgtcctctccccatctccaccttcccaagccaac

SEQ ID NO: 2141 - DNA, 593 bp, Homo sapiens
gcaggattccttgtccctcccgggagctccatgacacccttcactgcacgtcttcatcgctgcccctccccacgttcttatgctccatttctgtccctctaatctgggagccccttgcagcattgtctctgtatctttacattctcccctggcaggagatagcttctcagaaattaattaaatgaatgagacccagacccggagcaggtgagcagggagtgggttaaaatcccctacatgtaccactttaaagagtttcccaagttaaaacaatcgattccacatgttctgaaacctcatccttcttcaccattgctcagctctatggttctctggtttcctggaggctgaagtcttctctccatccctctcacggtctgcccaccccgtccactttccatctgacgtgctcttccctctgttgccatgcccttgggccactgattcatattgtcgcttctcagaaatcatgaatgagcattggaatatcaatggcatggccttaagtttatgcttccctaagtagaaagtaaatgcaaatatcttgagaaaacaatctaacttgaagaatggaaagaagggttgtttttcca

SEQ ID NO: 2142 - DNA, 105 bp, Homo sapiens
ttttttttttaaggacaaagttggctttaataattcatgaaaaagagaaaactagaaggaaactggaagcagaggacacagaaaatttgctgttagcagtgcacc

SEQ ID NO: 2143 - DNA, 144 bp, Homo sapiens
agcccaccaccctgcccttttgacactttgggtcgcactgttcctcctgcttggagtgtctgtcgtccatcccagcctgtgttgacctggcccacgtgacagattcctactcacttgcaaggtccagctccaatgtaactttca

SEQ ID NO: 2144 - DNA, 1065 bp, Homo sapiens
atctgtagctgtttctgatttgttttccttccggctctttatcccacctgcggctctctctgaggcattttagcgctctctccacacctctccctgcacgtctcgctttcggggtatcacggactcctccctgcagctgcagtcccatcttcatcccactcagctgccgtggccagggacgtgacagtgtattccttgtcttagatgagtaaatatgagtaaatgtgtgcttgcccttcgtttccccaactgtctgttttcagggatgacttggcagcatttggttttcatttcattcaggatgttgtgaggctgagactaaagatgagttaactattgcctgggattccagcagcgcttccgttaacaaacgtgtgtcccaagaagacccttggggctttttcattacctgatggaaaaaagccatagaccctcggctaaaacccacgccccctccttgggtggactatgagtggaggcaacaggattccccctcccaagggattctggtgtcagctagtacatcagccgtggccaacggaggatcttgtgttcgaagggaaggtctttgtttttcagacgtaggttcaggaaattctgattttccacctctatctcgggaatggattgattcttttaaaagttcactttaacctacttcactccacactcacggtcccccagagtgcctccttaacacagcagaaagttggcctgagatgatctcatgggcacaagccacataaggcggtcgggaccagtatccaagctcctcacccagtgctcttccacccttctctgcagcgcggatttcagagctggaggccaacagcatggccttccctctggggatcgcagtgaggggtggcgcgcactcagggctgcagaccagcaaagcaccagcccaagaaggacgggggagcaaggtgcaggcgcccccaggctgctggggacttcccagctctcagcacattctccttttcttggttaaggaagtttctaaagttgaccactggttaatcgttttgttattcatgctgagcaagaaaccagggtccaaatacc

SEQ ID NO: 2145 - DNA, 293 bp, Homo sapiens
tgtgtgtgtgtgtgtgtgttgtgtgtttggggaggggtgccctcccagtagggagctgcccagtagtttctgcctcttattaatctctagtacagctcgtgactcaccatgaaactcacaggaacacgcaagatggcccaaaatagtttccagggtggtcaccaggtgtgatgagaaagaagacaaaacaatgaacccatggatccatggtcacgtctacatggggaattctgcacacgacaccctcccctggactgtgaaacaatcattggcccaataaaggctctgataag

SEQ ID NO: 2146 - DNA, 160 bp, Homo sapiens
gaggagcatctcactgggtaagtaatcctggacacactttgggaaaatagctctaaaaagggagaggaggtaagcaggagttttaccatcttatgttcccgctccaagtcactgactttggactggaattttggcttggagaaaacgcagctggcctcag

SEQ ID NO: 2147 - DNA, 387 bp, Homo sapiens
ttctagatatctgtccttccatatcaataactgccccattctccctccataaagctagaagaaatgtcccgctttggagggtatttgtaaatgccctgaatgtcacatcacatctgcattactcacttaggatctatccagtccttcctctgttcagctgtgggaaaatataaactaaaaggacatggtttttgctattcagttgcctatagtcaaatctggagaataaagtaggaacacgggaaacaggaaatcactgtggaatgttgtcaacaagtacaaaataatgtaaagtaagaaggtggggaggcaaaatggaggaagcaccagagaatgcattcttatctatcagaggctgcaagttgggctgatatcatttcaccaaaa

SEQ ID NO: 2148 - DNA, 1134 bp, Homo sapiens
ggaggctcatgcattttgggaaaaataacacgagccatgtgcagacctctgcatttcacttcattgatatgtgtcttcctcctggactcctcaggcttctgagtttgcaacaccccccacccaacccaagtaggtctgatgtgtgttcccgcagaactagtgcacgtgatgttaggcaacgcacctcagagcctgctgccactgtgagtgcaattacaacctttgatcttacacaagcacgggctctgctctcaccagggtgtctgcatcttttcaaggtcttttactctgaggttggcgcagataaatccctgcaggagcagttgcacagcgtgcctctcagccgggacatcccgaccacggtgagtctttccatcctggcagcccactcaaaagcatgtgggcactattcgggcggattgctgatttggtgtgtgtgctactgtacatgtaataataataactaatgcttgtaatagtcctttaggatttccaaatgtcattcatgtacatttcctctgaaccatgccatctacatctctggaaaacaggcatctgacgaaagagtcctggcgtaaacgcttccatcctggactcaaccccattttatcatgcaagaaaactgccaccttacagctggtttttccccttcttttcttcataaagttcagttctgttttttttaatcccaataaaagctttataaataaatgtgatacatttgtatcttcccagctgcctgaagacacaatgcagaagaagaagatgtaatttgaaatgtatatttaaaaggtccaaattgtttatttttttttcaagcccagtgccccatccttccactaaccgattgttgggtcctcatctattttcttttctgtttctcatcaaggtctcttgagtgaatttttggccttaggcatcttgaattttcttttctttcactcccctcctccttcctaattctgccactactccaggctagagccttttgaattgctctacaaggagttagcaccagtgctcataacactattataatggtggtggtggtgctaactcctgtttgatccgtgccttctggcagcagcacctgagagaaacctgtttgtcatccatgataaggaactatcactt

SEQ ID NO: 2149 - DNA, 429 bp, Homo sapiens
gctggttctaccaaagctctcatgactcagaaggaatagatgcacatttccagcttgcttttattttgtatgacatgcttttaagctcaaaatagacttttgcttcggcacccagcattggccgcagaagctgtcaaccccagcctctgtagtttactctctcaagaaagggtgatgtgttgggttggaactttcaataagctcattgaactcaccaaggagtctgattgtccctagtagtatccccagccaccccagcctggtgtcctgcagggctcactgcttggcctggaacccagtccaggtatcaagagtgatacatgcctttgagtctagacagtgcctctgaaattgatatcctgcccatcacagaacctgggctgaatattggcatctctctgaaggtcactgctgtatatacctaaacaa

SEQ ID NO: 2150 - DNA, 473 bp, Homo sapiens
gccatgtggatggtagttatcattcccaatgatttatttgttaaatatattctctccattatcaacatctaggcattagagtatgctatcaaattctgcatttgatcatcttgccaattttgacaaacttgcataggggctactctatgcccaacacaagacaacacacagtccctgtttggaggcagctttcagtcttctgaaaaccacatccacacagataaaacaattagggagcaaagtaagatcagatgtcgttattaacatgctgcttagtagacagggtttgaagagggataggtaggtgagtgtgagaacaaatggtcaagaggtgaaagttgggactgaggaccaaagcaggaactttctgcaaaggcagactcaagggagggacatcccagttggaatggtttgagcccagggaatgaatgagcatgaatgtgtccacacatgcctctctctctctcaatctc

SEQ ID NO: 2151 - DNA, 235 bp, Homo sapiens
ttgggggggtggggggtggggggtggggagagttgcagaataaagagaatgaaaagaggaaatcaagactagacataaaggcagtgattcagcaatgcaatgggaggagtctgatatagcagaatgggtcctggattctgatgacttgtgttcagatttctgcatttcaacaaaacagctgcttaaccttactaggtctcagtttcctcagtgacatatatcatagtgtgtcttt

SEQ ID NO: 2152 - DNA, 20 bp, Homo sapiens
gcaacatctgtgtgaactac

SEQ ID NO: 2153 - DNA, 66 bp, Homo sapiens
actatatcatatcattctatagataaagatgtgagttattatatcgtatcattctgtaaatgaaga

SEQ ID NO: 2154 - DNA, 909 bp, Homo sapiens
tagtatgattcgtattgcaaagatgtgtgtttgctgcccttggctgtgcatggcaaaagggcaggtgctgtacagatttattttactcatgcaagtttttttttttttttactcttcatgttgcctctgttttttcctctctccagggacaacctgatcatcaggcaatttttgtaagcatgttttagaaaagttaaacccctgtcccaatccaggattcaagggatctcttttcatcaaaatgttgattctcctgcatctccctcttgctgattaaggctcagtgaagagtgcctagttctagtgtaagcacagacagctgaatctacaaggtgaatttttaatcgtttagaggaagccacttttatccctgcatgtactccttcatctcacatggcagagtagggttaaggggaacctctctgaaggttgaagtaatttaagctctggttcaagagtaggtaaaacagattgaaaaggagagaaaatatttaacatgtgagcacctctgtggaggtagctccccctccttttacctcctcttttatcaatcccttatttcccctaacaattacagattgtgttttcagtaagataggaccgattaccttaaaaggtagatttggttttctggattgaatgctaaaccggggagtgggttgacaaatggttaatctgatttaactgataaaatgaccaaaataccctggctgataatgtggagttgggctgcattgtttgataatctgccttatagtagctttcaatttggcagcatttcaagcccaccttatctttttcttaaaataataccctccagatttcctcctggaaaacagaatagtaaaacaaatcagggcaatttggtaaattttttagagttagaaatagaaaagaatgtttagggtg

SEQ ID NO: 2155 - DNA, 59 bp, Homo sapiens
tgaggggatggactagcaatggttctcaactgggggtacctttgtcccctcctgggcgt

SEQ ID NO: 2156 - DNA, 333 bp, Homo sapiens
cctccaaagccaatgctgcccctgtaacaaaactctggaaaataacttcctgtgaccagggaatagaaatccttacaactcctccctccaccctgctctgcacagccgtcctcagtgcattggaggaaggatgcttggaagatagcacttttctgtttctctggtgccttccactggacaatgctaggtggtcccaactgccactaaggcaactgaggcccagccttgacttgtgcggtcaactgtgaggttgaatccaagtttactagctattaatgaaggttgttttagaagaatcatagactttcagtgttgaatctttggcccagagaa

SEQ ID NO: 2157 - DNA, 228 bp, Homo sapiens
attcatgcctcctctcagctgtgctcatctgaactagtgaataggacagcctctagccttatttctgaagccaaatgatctgtatttctagcagtaggaggagaaagaacagcatcatgtaaggaggtaaaggcaaggtctgaaatcagagtcagagacttcagttcggaacaattcaacatgattttgtcaatgcagagtgaaaagtatgcagtaaagaatagtctt

SEQ ID NO: 2158 - DNA, 96 bp, Homo sapiens
gagtctcatcttttcttgggctcttcttacatggtaacccaggttgcttttgtatattgtgtcatgtatttgatagatataagtctaacaggccag

SEQ ID NO: 2159 - DNA, 200 bp, Homo sapiens
gagtcatccaggtgacagactgtgaatggagggaatggaaaaggcagttgaacatctgaaaaaccaggtgctcatttcagaactagttagtgatgctgtgtctacgagtcagataattagaaccgtataaagtcatggtgtgtttcatgagggaaatcagaccaactgttgcccacaagggcagttacagaaactctctg

SEQ ID NO: 2160 - DNA, 1034 bp, Homo sapiens
actataatgatgataccaattgtaagatgaaagtttattgttctggcaatctgtgaagaaggcaagagtcctgaaagtcgcctgagctttctcaccgggctcagtgaccagccttgattttctcttctatagatgtgaattcactgctcgcataaagccaccagcggtgttgagcagacaaaggggttttacattccagaaagaaccaggcaaacaccaagtagggggtattttgcagcaaagcactcagcttcacccaaaaaatggtggaggaagggcctaggggagactgttgaggtcactctggcctctactccaagaaagcaattcccacgactctgtttctcactaacttgtgtagaaatgaagtgcaggagagataaacatcttgacttgtcttcagacttccacaaggcaacaaaacaaagcaaaagactgtttctctactttgaaaagagcatgttcagcatctgccctagtttgatgccaggctgaagtggtgatggtaagacctttaaggacagaaatacaaagatttatgctgtgtggtattttactacaaattgcaagggttatcacaagttacaatacattgaggattccatttgagaggagagatgtcaggggaggaagtgaaggtgaaatcactgaattcaacacgtttctgtggccctgaccactcagcccccttgatttttaccattatgccactttccggagtgtcagtgcaggaaaagagacagacgggaaacagccagcttcagggaaggtcaccctctacccctcagaatgcacccaagctgaaggtagcactaatcttccatatccagtaaagagttccagaattttttgatctatatatggaactacaaatacgattttgcttggttttcagtggtaacatttaaatttctaatacgttaacttccatggtcgtaaagtaataataatctagtttccagtgattatggtaaatattgtttgttgttgatttaaacattatttaatattttttgtacatgtactggccaatt

SEQ ID NO: 2161 - DNA, 760 bp, Homo sapiens
agccttctttccctttgttcatgaaacagaggaaacacccatcactggtaattaatggtagctgtgtttggtattaagtgatatctacaatactgtctgaatccatatcaccacctatacttcatccagcatcatgacttcccaggagtaaaggatcctaaagcaaaactgggagagtgctgtgttggtttgaaagtgtttctgcttccttgaggaaagcctggagtgttagtcgggagaggagtgagaacagagggttggatccacctgttgcctccagtctcttaaccaccaaacttgacgtgaaacctggagacagaaggtgaagctcaggagcacagatgtgaggaagtagagctggagaggggatctgaaggcaggtccacatgtgcagcaaaggccccttgtgaagccacatgtagggtggagtggaggtgggtgggagggaggggcagactgaagacccaggcaaagagtcaaaggggccgtaacttgggcaccaaggtggaaatgggatgagggaacaggtctgaaaggcatggtggggtggctggagggaggtgggcaggagagtcagtcctgtccctggaggtgctaatccaaggcctggggcaggagtactgatgctgtgagtcaagatgcagggctcagtagtatcggctggcttcttgatgaggtcatctgtttacatgagacatcttggcttgatttctttctttaatcattcattagttcatttattcattcatcaagaagcatt

SEQ ID NO: 2162 - DNA, 319 bp, Homo sapiens
gacaaaaacacgctcttctaaggggttttaaagtgtgaagtacgtgatcagattgcatatttagaaagataagtagtatagcactgtggagtccagactggaggtacaggcagtgcagcattggtggcaggggaatcagagcccattgtcatatttatgaggacttggtcttcaagggctgtaaggatgaaatgacagaaacacattcaagtgatatgaaagaggtggaatctgctgcataggtaactgatgagatggtggtgaggggtgtagagtgaactcatagaggaaagcatcaagaattctggccttgggtaat

SEQ ID NO: 2163 - DNA, 43 bp, Homo sapiens
aggcaagcagtgaagctatgttttggtttggttttggcagtag

SEQ ID NO: 2164 - DNA, 168 bp, Homo sapiens
taggggtgcaggtatggtagggaattactgtttttaaggtgtgtgagtcttgagcatagtaaatacagaaggatctggtagatactggatctagggggatcaggacaatgagaggagggggaacagatggggcagttcagggcctgagagatgagccaagctctggaa

SEQ ID NO: 2165 - DNA, 115 bp, Homo sapiens
tattaagtattcattaattatttgttgaatgctttaaaaaattgtagggatgcccttaattcttcttagaaacaatggacgttcaaacatctgcaaaagagcttgtgaagaaagt

SEQ ID NO: 2166 - DNA, 221 bp, Homo sapiens
taacagtttttaataaatacaatgtaaatgtgttaaagtagtggcacaattttcattagggtaagatcaccagacctgcatggtcagggaaggtgtcaaagggagggcttggcctttggagtagtcagggagcctaggtaagcagagaagaggaaggttcccacatgcccaagacaatatcatgaccactcatttcctgagcacatcttccatactggctg

SEQ ID NO: 2167 - DNA, 139 bp, Homo sapiens
tcccaccgatcagacccaggctcccaattactatttagtgctgtagctttggggacacaccacttttgccaaagctcaaggtggagaaagccctcttccgctggggcttcctgctcagggccctttgtgcaggggaagt

SEQ ID NO: 2168 - DNA, 90 bp, Homo sapiens
aaatttcagtccctactttgtaggtacaaatcaagacctcagtttcttcagctggggcttcctgctcagggccgtttgtgcaggggaagt

SEQ ID NO: 2169 - DNA, 895 bp, Homo sapiens
ttttaagaaagtcttcctggtagttctaatgctgtttaaaatttgagaactaaaattccagtccctactttctaggtacaaatcaagacctcagtgtgcagctgcagctattctctgagcatctgaaatctgcaaatggaaagaaggaactggggaattacagccttagaaagaatcattacctgccttccagcaacgtagtactttgatcaaagagttctgatgttcacagtaacatttgctagtgtgaatgtatctagttctaggaccatggatagatttcaataaagggccatcctccagtcttggaaaatatgtcatggctatttttttcttggcaaagtttaaaactgggccagtcctagacaaagcaaaacattctctgtgccaagcagtttcacaggggcctcgagatataaacctcatggaaattgtacaatttgcccaaacagatgtactgattgttagcatctttcttgtttggtcattgacaggaggaagtgattggagatttgaaaccaggcactgaatatcgtgtgagcatagcagcttacagccaggctggcaaagggcggctgagctctcctcggcatgtcaccactttgtcccaaggtaaagtaggttcaaattcattaataggtggcaggctgctatccatgcatccttcattcagcaaatatcaatagggacttactatgtgccaagcactgtgctaggctctgggaattcagtagagaacaaaagtaagcacagctcccgccctctcagaacttagtggggtgagtctagacattccctcattagtgtgtagttgcagagtgtgatagatgctccagcactgtaggaatgtacaacacaggggtaagggaagaattccctgaagagatgacaacta

SEQ ID NO: 2170 - DNA, 397 bp, Homo sapiens
gtgaagtaggagagtggtcattaggccaagcaccgacctccagaccacatgtcttggggaagcttataaaattctcttggggcctagcaaagagaggactcctagtcagttctcttcttcccagcacttttgttctggccagtggcttagagtctttactcactggctgtggccgcttttacttcacagacagagttgttgttgataggccagggggcatctcttccttcccacagactacctagacaacatggccctgttgcagggaataattttgcccctgtgagcctcagcaccgctgtcctgaaggttgtctctgtcacttagacttggaagctggagagataagttgccttcccaccttctggcctatttgaccatgcttcccactgaaacc

SEQ ID NO: 2171 - DNA, 493 bp, Homo sapiens
tgtggctcctgcctgcccttctagtgacagggagtgccttccctcctataccatgaggcactcacactcacctcactgttactttacttcctgctatagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggtgagtgactgggagcaggacttgggagaaggtggcagggtagaactgtgaaatgtcaggactccaggggactgctggaggagctttaggtgccacctctgaaaagtcaatggggaaactgatggatgtaggctggtgagatagcagtcttcaaccatctgtcattaatcagtccctcctttcaaaaaacctgctgaaattttggcttctctaatgctg

SEQ ID NO: 2172 - DNA, 71 bp, Homo sapiens
tgaatcccttcagcttgctgtggtacaccggttcttcatatcatcactgatggcttcctatttccttcttc

SEQ ID NO: 2173 - DNA, 1190 bp, Homo sapiens
acactgatcttgggagttaacgaggagtctctaacacactgacggccactgaccagcttattttagagatgaaaaagagggctaatgtgtgggaaagggatctgcccaaggtaaccagattgtgatttgggcccaagtccagggcagaagaagaggagttgggtagagctggctaggagtggcctctccctcaagcctttctcatgtacccatgctgtctcccaggaaacaaacacaagtgggttccattacaaatagacatgaagcctgaagtgcccagagagaaactggcttcacgccccactcgcccaccggagcctagacacatacctgccaatcgcggagagatcaaaggtatgcactacccactatggagggcctggacttgggagacaccctcaggcctgacctggtacccctctccccatagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaagtacgtgaggcccctttgggctccgggatgtccaagggtgtgcagcaggggtggtgggcaggaatctcctctccctcatggcacccgtttcccccatagcccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagatgtgagtgtgcggaagccttcttaccctggagaaatgagtgagaggttaggggttgctagagtgtcatagctgggcaggcccttctggtgcttagcagcagtttcagcctcaggctgaaaagatagcttttctcattgtttattaaagaagtgataccacattctcattgtttattacagaagtggtacaacatttaccttaagaaagttagaaactataccattacaaaaaggaaggaaaatatttagaatctacccccttctgttcttccatttgtaatgacaacattgacagaat

SEQ ID NO: 2174 - DNA, 690 bp, Homo sapiens
ctctcagtccagtaaggaagtcatacaagaaaataaatggttgcaatagagtgtttataagtgttttaggagcagaagagaaagtgaccaacaatatttggactggaatttaaaggaggatgaggagtttgacaggcatgtcgaggggcttagggcagagggagtgatttgacccaagcaaggtagggtgtcatgaagggatcacatcatttcttttcagccctcaacactgttggtatataggataaggatggggtaggtcagaggctgtgtgagattgctggggtgtgtagcagaacaaggaaggcatactcataaaactgatgcaccaatccctcggtgataactacttcttccctccacttagtgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggtatgtcttcctccctggagctgggatgcaggggaaagaaaggtccttagggagctggagtttgggccaaggcagaaagccctggaagagtcatcatctgatgacttctgctgaagtctcaaggcttggctagtctcctcctctccctccttccttcctttctctccctctcttgctc

SEQ ID NO: 2175 - DNA, 51 bp, Homo sapiens
tttatatatatatatagtttgtgagaatcagaatccaaataatacctatag

SEQ ID NO: 2176 - DNA, 130 bp, Homo sapiens
gcctgatcagattcaggttttgaagttttttcccctccttgtcaagaatactttatcataatgatgtattttctctcaggtggcacataacatttcatttgattgtctctcttgtgctataagctgccag

SEQ ID NO: 2177 - DNA, 55 bp, Homo sapiens
ttgttttttggtgagataaaatacatcatggagttattctgttttgttgttgttg

SEQ ID NO: 2178 - DNA, 148 bp, Homo sapiens
tgttctggtattttctattaaagggtctttacgtagacttgtggatcttttattttacctactgctttcttccatgcccataatcttaattcctaatgataccaacataattactcattttgttttatttcacagtatgtctaccgtc

SEQ ID NO: 2179 - DNA, 394 bp, Homo sapiens
aagctctacattcttacaatacctccactaccactgaaaacagtttttccacttatacagtatcttcaagtcatttgaaagaatctttgtgtggtttcacatttaaattgatatatatattagttttattttgcttccaagttttagagattgctttctccctacccctataattttctaagttgttttacatttgtgtaaaacatttacgtggttctagagtctcagcatggtatagtcatagaagtctgacttaaattctgtcacttacaccctttcttctcttacaggcaaactttttagaacctttccatttaagaaaaaagcaaatgcctctacatgtatttgtatccttggtaaatggaaatatacaacacatggcatttcttcaatt

SEQ ID NO: 2180 - DNA, 51 bp, Homo sapiens
tgcttttttgattaatattttgtgggtttatccacctcagcacatgtaaag

SEQ ID NO: 2181 - DNA, 1079 bp, Homo sapiens
cctcctacaagtttgaacatctcacattatctaccagtcgtggaagatggtgtcaattttcttatattactggtagcattggactcataccaagctcaggggaacccagttgtctaccatttccaagatctttctgtccaagattttcttcttaatcccctcttccttctcctccccttcaggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacaggtaggtacctgctggcatgaagattgcccttgtcctctgggcaacagtcctcctcagggctggcatcaggaggaggactggagggatgaggacttcccctttccaccctttagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaaggtgggtgaggccttgtcccttgccttggttctagcactctgagctagggtgcttgaaggggataacacatgggcacagcactctagctctgaggggccagcaggaaatctgggtagttcaggatcatagtgtgagttgaagttaccagtagtggctacagaaaggttgatttggcttgtttccatttcctgtggggaaccaccctttagggcgccctactgtgtgagttcctcggtgacatttttcttaagggatcatgcagcatctggcagcgatgtttctggcttcttgattcttggctcttctttttgctccatctaaatttctggggctgcgtttttggtgtcttttccctgagtatgtccccactatcatgtatgtaagccccttaggtcctcagaagaaggaagggagagggagcagatgcatggcccaaatatggagt

SEQ ID NO: 2182 - DNA, 618 bp, Homo sapiens
aaggagacattagaatattctagaaatagtttatatatataaacagatgaagttcactgttaaagaagtattgcaatctctaactaaaattactacttcctttttaagtgctgaatttttctccacatacctgctcactgtcacccactttggagacctctggcctggggcttgtgaggagactgcagaattgaccttgaactttgggtctatggaattctatactcccttatctattttcccacagtgattacctctcatctcctttctcttgcctgcctgttcatacacagaattccccacagttgtggcttcagccctcaaaaagtgttggagatccagccagagacatgaggagaaaggtagtaagtagatgagggttttacaaagtccaggcctacaaagttttgtttgaaacaggggtcagacttagctcccattccagaattagagcccctactctgacctggtctatcttaaaccttaaaaaaagataggtttagagtttatgtgctcttggcacagcagggaatctacttttgaataaatactgtgggtttagacaaatgcttctctctcagcgtctcatattcagtctatcaaaacaaatagtttttc

SEQ ID NO: 2183 - DNA, 101 bp, Homo sapiens
ggagcttccagtttattgggagatgttgaatagatggataagtggatgaatcaacctgctgaacttctgtgtgtccactcctaagctaggtgctatgtagg

SEQ ID NO: 2184 - DNA, 702 bp, Homo sapiens
agttgtttgtgcatgactgtgatatgagctgtgagtggaggaacctggacttctatgaaacatcctttctcatagtcataaagctgactcccaggatgacgcttgtgacctgctggtgttaccagggtcatagttgaacagtcttatgttgagaggctggagcttccctctcatggtatagctacagaatctgggccaaggatctctggtgattccttttccccttcgtctgtcctattttagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaaggtgaggcttggacatagcagtgagtgtggagcctggtgtgcctgtattgtacggagaagaggaagc

SEQ ID NO: 2185 - DNA, 1459 bp, Homo sapiens
ctgacatctagcttgggcattaggagtgaggggtgatgtgtaaacactgcaaactcttcaggtgaggcggtggtgattattatcctatctgcggatccatagttaatattctgacagttggctagacacttttgtggggaacagaaaaagggttagattgttatttctagtcttaaatatttaggcatctaaaaatttagaagccttttaagaagcttgtgttgagtatggaaaatggagaaaagataagtcttttgaaaaattgctgctgcctggaaatagtcaaaacatctctgttgtgggattttagagtgggtatgtttggtggtaggttgtcctagggtgagcctttgtaataagtagcagtgtgtttcctggaagtaaggaggaaggagagttgcccagccactgtgtgataaggcagtagcagaaagagagatggggaaacactggagctttcaggggggagtgtgtagtgagttcctgaggagctactgtcagcctgatctcagtcttactacagggagggcagggcaagcactgtcttcttctgggctagcacacttgtgccaaggtaactggggtgaggaatggtgactgggcagctgagagcctggggaccagaattccacgtatgtcgacgtgggagctgccctctccaacttcctgccagtcttgattccttaaacaggctagagcagcctgcttacttacatctttccccactcatctcatgacctctgcagcaagaagtcgagaacttcaaaaaggtcaatatgatcagccgggagcagtttgacacactgacccctgagccccctgtggatcccaaccaggaagttcctcctgggccacctcggttccagcaaggtgagaagcagacacctgagatcctgacatgggtgagaggatctagggcccttggactgggggctatcctggggtggatgccacaggcctttccctgcttcctgactcctctctctgcctctgcagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaaggtgaggcattcctgtcgggctgctcagagtcttgggtctacttcattgcattccagtgctttgcttctctcccttgccttgtctgagctaaggaagtgctaaatccttcacctgctctgtgttctgaggctggtgggcttacctaggattaggtagccacatctgcaaaatatactgggtgtgggagtggtaaccccatgttgaaaggcctaaggaggattgaccaggtatgagtccttgggcaaatcactgcattc

SEQ ID NO: 2186 - DNA, 1098 bp, Homo sapiens
gtgtgctgtcacttctgaagtgaaggcacagactatattgatgttaataccactcagcataaagatgacatacgcagagtattttgtcaaaaagacacaacagagaatttacacatgcacaaatagaaatagacttgctactatgtaattttatctaatagagcattttctggggtcttaaatggactgattttgggatccagagtaaagtcacgtctggtccacatcacagtttagactcacggaagctgcttcttctcatgcagatcccgccacgctcagcacagtggctgtatgaggctggggggcttcacctctgtctcatgcctgctcagtcacctgctgagtctcctgcctgggcccctcagggcttagctctactcctctctaagtggagaagtcgactgggagtctgctacgggttttttcctttcaatttcaacatgccatggattcatgagagcaaatgagcttaaatgcaccatctataagcctattaatttttgaatttgcacaccagaggagtgccacctgcccacattctacccacaatgggatgccccacaaggatgcagagggagaaaccaggctcaacacgcctgccgccagcacgcgcctgccaactgcacactgacgttgttctcctgtgcctggtgttgcagccccagagtgcctattgtgggcactgaactcccgtgtcatgaggtgggcctgggcccggccgcccttcctgggcctgcctctgaccaccccttccccccattctcatgcatgtagacagttcatacatagcccagggggttttacctcattcagctgtttcttcctcctttctacaaactctgaggacatactttacatgcaaaaccatgccaaatgccatggggtatttaaagctcagtagcctgtaatccctgactcaaaggcagtaaaaaggaaataatttttgcaggtagttttaacacatggcatcacagcatacactaggaatggggaaattttgctgtaaggcgtggaaaaggcagtggggagaggagggagtatcatctttggaggagttactatattccaggcattgtgtaggaggaatcctttgac

SEQ ID NO: 2187 - DNA, 560 bp, Homo sapiens
atcattagcttctgtaggaacaaaccccatagatgttgcattggcctagtaggggggcagtttgttttttctggttggcctggtcatcagaataactcatctgggtaatacagggaggggttttctaggggctcggttacacacactggacttgtttttaacatataagagaggctgggagcatttctgaaaaatggcctatagaaacacacggcaatgacaacctgtaaggaggatagaactggctgcaatccatacctgtaatattcaaactcattattaatcttcccccaaatgtctatatagagaaccaggtgatatccaggttaagcaaatattcaagagaaatgtaaatgtgaccttccttaattaacaaatttgctaacatttctcatcactgcggagttgctgtaggatgttcagctgccccttgaatttacatgtggagtaacaaacaaggaagcatatgtaatgtgctttgccgtttgcaatttcgcaatggaaaagaggtgctgtacgttttgctttgtaattttgggttatttaaaagaaatcaaaat

SEQ ID NO: 2188 - DNA, 880 bp, Homo sapiens
cctacacaggcagtacaagtgatgagttcatacccttggaagggaaggagcttgtgcaagcttgatctccacagagaaggaaccagaaggaccaggtgtgtcccagtcagctccgtcatcccagtcagttcgcagtctccgaggccaggggttttgaaacctgggaagtgaaatgtgtgcatgcagctgaagaagagacagacgcgtgagtgatgaagactgacacagaaacacaccaagcagaggcccgataactgcgaggaattccgtggatgtgtaccgtgtttggagacgggataattcctggatttaattgcaaaggacccagtctttctgcctgacatattgggtgctagcagaatgttgccataacaaccaagcaagtaactgtggcaggttagcaagcagccaaaaatcattataatatttaagaaccaaaactttaatattttattttcattaccgtcactggttttccttcctagcagaatggattcctgtgctagttatggtaaccttttctgcagtgcttttagagcaagtactgttgagtttatattttccaaaagattaaaaatgatccctttgatgaatttcacttttatttgggtctttttgtgtaaagaaatctgtggttagcagtacaacaaatgtgttacaccggcttccttttcccggtcagattcagccttccgctgctgggtgctgttcatcatcatgagtgctgaaatgggagcctctgagcctgtgtgcggcacccggcgtttctgggaagcttcctatagatttttcctctcctggtttgagtacaggcatgaatgcacgcacacatgtacacgcacgcacacacagatccacacgcatgcgcacacacatgtat

SEQ ID NO: 2189 - DNA, 1502 bp, Homo sapiens
catccatgcataaaagtcattcgcagtcatgtctatgctcaaacccattaaaacatttttgtgtccctgtttcagtgtccgtattaaatggcttggactttactcttggctccaagcatcttagatttgtggtcaccagttacacttcggctttgtagacgtctatcattgtcaacataagtttttacataagtgctgtcattaaagtagtctaacttactgtatattagaatatatgatatttctgcaaatatttatattttctatggcgttcattattaatatagaaattaaataaaacatgcccagtaatttatcatccctctcttgggttgtgtacctaggaatgatcagataacaattgactgcttaatttaaataaaacaatgcactattctcagcaggaattaacattatttggaaggtttgattcatggtttttgcattgtattggtgtcacgctgttgcactggacaagaccttaaaaaaactcttggaggctgagattcaattactctcaatcaaattgtaaggaaaaaccataacttatctaaaacattttttattatcaactgttttcattaatgctttgtgtttgttttataaaaagcactagaacaaaataataacagccttcatagacagtggcacacaaaaatagtttttcctcatgaagcaataatcgcatatagcaaattgaatatacttccacagcaaggaatgttgaggccacatggtcagaaaacagttccatgttacgacgcacatttaagatgtttataaggatcaacttcttaaaaattttaccaagagtgaaatctatggaatagacgttttgtaaagatggatgctatcagtgtgtgttttgagaccactttttctcaattgtccaattgtgtgattatgtgatgacattctctaaacataaagcgcttttgctggtggtttcggcctgatgagctctattttcttgaaacagaagatgagtgcattaagaactgtagcttcaacttatcaaactagcaaattgattttctgttttccatttcaaatcagagtcacagtgatttggagtcatccgtcccctgtaagtctcttcttcctgctctaaatattaatgtaataagatatctaggttccttacctatgaatgtgttaggactttatctggtttactgttaggatgagataaaatatttttctacttaaagtctgttgttatcacttataagagattttacatgtggactatttatttaatggccctactaatgttttccatcaaatatctaaagccaaggacgctcgtcttctcactgttggacttccgggtaggacgctggaaacagccgtcggataggccgttggtcaccgtcttccagctcctccacaaagcaggttccagagctgcatcccctgccataatagcccgggaatcggcagccagcaccgttgccatgctgagttttcacggctcattccactgaggaggcctcgccagc

SEQ ID NO: 2190 - DNA, 739 bp, Homo sapiens
ggccagctaaagaaaagagtgggttggattgtggtcaccttggtgtgccctggggggtgttgagatgcaggaagctgctccttatggaggcagctcagggagttgagagcagagagggcttggtagctcccaggtagcaatatttcaccactgagtaagcattcagttgtatgacttcctcaggcaattcagtgtaacactggagggcttttagagaaaaatgtaattctcgttttaggaaaaaatacccgtttgttcctggttataacttttgatcaaacgacctcagttgagtgtgttgtgtggcatagttttacaagggcctggtcacgtgggcctctccactcgtggcatctgtggcccctctaacgcatcccatagtttcacataactgttccgtgcatgtggtggagggtggaattcctccagctctgtgtgtcctctgtcctggtttacctcagccttctcccatttttcccatctctttttcctagtttgcttatttacatgtcttaattttggaactttttttcatgttttggaactgtgtttcaaagagccattctttagtctcttgtttgctgtagaactattaaagaaaattttatttttcccctaagccagcaggactccaactaatgacttccaaaatgtgtgtaatgaaacacagctccggttgaaaggtgccaggacaccggcacacccgtgccaaaatgtggatttatacagggatgcgtta

SEQ ID NO: 2191 - DNA, 2063 bp, Homo sapiens
ccccttaatcctctacctgcattttctggtgaatacaacccaaatagggaggtgagaatttcctaacgataaatcacctcgaagagacagagacagaccgtgttcgttagttttcgttaaccccaagaactcatggacccaccagaataatccacacccgcagtttgaggaactactgtgagatacatatttttctgcatgaaaatgagttgtaaaattattactgcagagttttacctttgaaacctgtgaaacctttcagtgtgagaatactttttaccctaggacacacagttcccttgagatatgcatcggttactacacgtagaagttagctgcctgtattaacataggttattaagaaacaggagttttagcacaggtaaatttaattacctacattgaagttagccatctgtattaacaggttattaagaaacaggagttttaacacaggaaaatttgaattacatacagttcatgttaatccaaacattcaaatgctgcacgtattttccattttactaaatcattattcacattagggttatgcacacaagggctaagtctttaattgataattctttccttctatggatataaatggcattgcctaagaattcagctcttcgtttgttgtctctctaacttactggctgtgctatctcttgatttcttatgtctatctatggaagaagattagaaacctctattctaaacaccgacaaagtctttctggagaatgtaagcagggaccaggcaaacaagaaaacctccggtgtaattttctctgaattagatttgtttgcgaacagcttgtggcctttcatctttgagaattgtgactatgttcattgatactaacaccagaggttaaaatgtgttaccaagagaacaaaagggagataatctttagttcaatgtagcaaaacaaagtacttgttgaagctttgatgtttaaggctggagaaataaaaaaaaaagaggttgcatttctggctcttattttccagttcttaaatccttcattttacattaggacccagagacatcaagctgcataaacaagaaaacttgttttgctttatttgtggctctacatgaacctaagattatgggaaaacattctatcaatagtctgcttctggtgaacttaacagttttgagaagaaaagatattaccctgctctgccaaattccccgagtgaggatcacgtggggttgcatgcgagtgtattcccacagggggcttggctggattgactagcggcgggtctgggggcgcggccggattgactagcggcgggtctgggggtgtggccggattgactagcagtgagtcttgatttcagcattttgctaaagaccttcttttggagatgttgctttacaaatagataatcactcacttggcactgagagaataagcccgaatttctgtaggaacccagcacctgccacggctccgacgggcgacctgactgctgcaggccatgctctgctgtgagatgcggtgtgatatgggttcaaagttttgcatcgtccagttcaatcatcaatagaactctaagggtggcttctaatacctgcccatgcacccattctcaggtcagcctcgaggggccatgcaacaacgtagctggctaatgtggttcagcaatggggagcactgtgttggcaaagaggagatcaacttggagggagcagggggaagcctggctcatcacggctggttaaaatccaagtttctagccatctaccaagtaggttgtttaacctgttgtcatgtatgtggttggtaaattagagttgtggttgtcacctcttaagacagattggccttatattatatggacaagctacaaagatcaagtgatcttaaaagtgatatttgaggcccaccccagattattggattaggaatcaggaaacaccttgtggtgtgacttcatgtgagttcctggacacctgtgcgtgctcgttgcccttgatggccacacccacctgtgcctacctcaaaagacctcatcaaaactggtgttagaagcttgaggtggaatgca

SEQ ID NO: 2192 - DNA, 409 bp, Homo sapiens
tctgcttctgagaagacataaacggaagtctccagggctccccccatgtgtccatgtgtccatgggtaaacctcaggttcgcccatctctctgtgtccagtgggagtcctaaagccagcagtgctgctctctgctctggggctctgtgacagctctctttgggccctggatcctcttggcttcacttatagggagaggctccatcaccagctgggcctcatcccctgcccactcacccctcggggtcccagcatactccatccccgagggcctcctgggacccctgcatcccctgggtatggactctccctgccttctccgtggagaaggcatgaggggtggcatattccttaggaacacagctctggagccgcactcctgagcccgaaggcttgggctcctccctcag

SEQ ID NO: 2193 - DNA, 30 bp, Homo sapiens
cagagcacgtggtgtgtggcgagtgtgggc

SEQ ID NO: 2194 - DNA, 508 bp, Homo sapiens
tgaatgcttgtgggtagatatgctgtggtcagcctccttggaccaaggcgccctctttgctgtgggaaggctgaggggcgtgaggcaggtgagggaattccacgtctgtgcaggcgcagtggtgaccgcaggaaccaccaggacagacagagacacgcctcttgggaaggcagccaggcagtgggaccgaccatatggggcagtgcagagagtcgggggcggtcgcgatgcaaatcgcattctgtgtggccccgggggcatggatcgggggtattcacagctggtggttttgaagtatgagtgggctccagagggccagaaaaatggtagctgggacgtcttgacagcaagcaagtggtcgctgggatggctgggtgaactggaagtggaatctcaggacctgagtctggggcttcaagttcctccacagggtcagatgcgaactgttcccagggtcagatgtgaaccacggagtgggtgcttggaaaagcctcagggcgtgcgtggc

SEQ ID NO: 2195 - DNA, 224 bp, Homo sapiens
gaaaccaaggtggtgagtgcttgtggatagatcccctcccaaggcgggctccctctggaggccctgagggcgttggtccctccgctgagtgcttgtggatagataccctcccaaggcgggctccctctggaggccctgagggcgttggtccctccgctgtgtccttgctgtgtccttggtgatccaggcccatggaagcgcgtcaccgacccctgcccctgctt

SEQ ID NO: 2196 - DNA, 556 bp, Homo sapiens
atcccagtggccctacattttgggggatgatgttcatcccgtaactcctggtgatggtggtgtcctcactgaatgactgccccacatttcagggcatcctgtgggctgccttttcctcagagaggggcctgcgggttccacatgctgacctccctgtgggcctgggaggaggcaggaggccacagccagggcagcctgggatgctgttgaggaagaggaggtgggctctgccccctcacagtcaagggatcttagggaagggagacttacttgcattctgagtgtgtctcccagccttcaatgtgttgatatttcgatgttgtgtaataaacacaggcattggtgaaccatggatacttctctatgttgggcaaccatggcagttcccccacgtgggcagaggaacgaattccctgatgcaccctacacctttccagcatgaagaacccatccaccaggtctgttttccaggaagattctcatctgatttggtagacctggcgctgtcctttgccagccagccttgttcgtggtgagccattctgtggaatcgtcg

SEQ ID NO: 2197 - DNA, 148 bp, Homo sapiens
aagaagtgtgtatctttaaatagtctatgggttgcaaggcagtgagatatcatgtgtagacagaaacaagacttaactggaagaggtatggaattcaccaagaaatcctgaactctaatcctgaataattattccataaaagctcttg

SEQ ID NO: 2198 - DNA, 692 bp, Homo sapiens
tcttttgaatgcagtggcagaacataaatttgggatatcctgtctaaggaagaggtgtataatgaataaattgatatttatatcaattgtatcagttagatcatgttagtggggaatttttaaacacataaggaaaaaaacaaggtgtctgtttgtgcaaggcaaagagggtagtcttgtagtttgcccaattcaaactcatttacccagctctgggaatgccctatctgtacccctaatcccattgccatccacatggccagcaggactcctagcagccgtttttgtagtgtgatccctcccccaaactatgtttgattagatcaagagtgcacatgtgtcccaagctgagctaaaacaccccttctcagaagaaactggaaatgcagtttatctgtatctatatctatatctatatctatatctatatctatatctatatctatatctaaatctatctcacttcaatgtggctctctcctgaatgcaggaaacaaaaccccaggactatggccatgttttcccatacagagaatgagaagcaacggaaatctgtgtgagagagaggaaagagcaagaccagcaggggccaacacagagcgatcagccgtggatttccactccctgcttccagcttgagcatggcttgcatttctgcacttggatttccagagacactcccttacctttaa

SEQ ID NO: 2199 - DNA, 804 bp, Homo sapiens
aagagatccatcccaggatttgcgatgttccttttcttcttatagataacctctgttttgagacttttctgcccacaggaatggtttggtgattgtaaacacagatgaactgaagagactgaatgagcacatggatcattaattagattatttctcattctggccatgtctatatcaatctatttctgtcagggaatcataatttccttacatagtcagccgctgtaaaagcagatctcacttttccccaaaacagttttcctcagtgctggcatgagaaaggggtgagattttggcggtggggaatagataggtttggtcccacacagccctgcgcttagttcaactcttcagcaatgtcccaagcaaggttgccggtcttcagggtgggttttcagtagctgcacttctcaggaagtgtgggcacaggagggagcagttcaagttcattctgggaaggctgaagatgcaatctgtgagcagcatggaacacagaaacgcagagcctttgcaaggctatgcacagagcaggaaaaagcagaggtctccaaacacatgaggagcagagagatccccttattgcctgccttggaaggtgtttcgttttagaaggctgggaagcaaaaggaatcatctgacctggaaaatcgcagggagcccaagtgaggaagagtccaatgcacagcatctatggagaagcacaaggtaaactgggaaggtgcagatccttagggaggactcagtctctcagcagtttgtcccaaggagcattctaggggaaatttagtcacacttggagggtgt

SEQ ID NO: 2200 - DNA, 145 bp, Homo sapiens
tggctcaagaaccaatttaaacaagaaaaatgtaaggaattccctttctcctgcccaaaagaagtcagcatctattgactgctcaccatggcaaaaaacctgtttgatcaagtaatgaggtcaacatttgtatagaatccatgtg

SEQ ID NO: 2201 - DNA, 660 bp, Homo sapiens
tcttcttaaattattttaatgtagcaattatgtatttaaggaactaataaagcttagttgttgaaaaaaagaggttgttgtgttttattttccataattttgattaggtgaacttgaggtgctgatgaagagtagctgttgaagtgttacataacaacttctccttagttcaaagtgaaaatgaactcaataaataggagtcaacgttaatctagggaattaaaattcaatttgtttttaaacattgcctataattattataatactgaaatttacatagaaatatacatgaaccttaaattatttccatccacttacctagtaaatactgacttaagaaattgctatgctgaattcagtcaattatctctaggtcatctagtgagagcttaattatatttgtggggctttgacttttcagcacaaacaccatactcattttcccacatacattataccaagaacatatggtacagtgtgtgattcactagcagagagctgcttgcaattgagatctgtcaaatgaggacttctcagacagctatgaggattctttgactcctgttgttaaaacacattttgtagatttaaaatatattcatagaaccaagtcttctgagttttcatcttctaggactagctttcgctgtgtgccaagta

SEQ ID NO: 2202 - DNA, 242 bp, Homo sapiens
gctgctcatttcagtaaaccttcttgcgtcccctaagttctcaatggaataacacccgtcccatctgttcctctgtctatctcctctgtaagtcccctcctatgttgccatggcaacagtacctgctacaacatcataacgagtttactatattatacttctgttagcaaatgcaatacttggctttcaaaaccatggctttttatcctttttatccttctttaagagatagttgggaaagg

SEQ ID NO: 2203 - DNA, 275 bp, Homo sapiens
ggtagttgcctggtgaggcagctagcattctcaaggctcatcttcccactgtttccttagcccttgttcccacacttaggaagccaagagctgtaagccactaccatcccatctttcaccctagcagactccatctcccaccaaaacatccagaagtgcttaggataggaaaccactggcaggaagactcacactagtggttccctcaaactacactgtgcctccaattcctccaggctgcacatcaacaatacatccaacttcatttttctcag

SEQ ID NO: 2204 - DNA, 111 bp, Homo sapiens
acattcaacagagtttgagacacaacggtctagattttctaattcaggtgccccagcatctaatagttagacagtgtttttcaatgcataggactttgctggggaaactga

SEQ ID NO: 2205 - DNA, 562 bp, Homo sapiens
acaccagagagaccaatcagggctggatccatatcccagctcttccacctaagtagccataagcatatatatatattttttttgacctggtgataatatctaccttatgaagggattgtgcacagtaaacagaagccatgcattttttactgtttctgaataaggcatgatacagctagaggagatgtttaagagtaagacaaaaaataccacaatctggccatcatttctgagtcatgatggagtctttctaaggacagacaaccaggggtaactttttccaacccaaaagtcatgctataaaactccaacacagtttcgatagacagaacagagggccacagaaataaagatacaattttgatcatttcaaaaatctattgatccatgcatatttctgtatttcatcaaaatctggacactatagaatgtgtcacatacacttagttccagaaaggaggagagccactgccttggagaatggtgcttggacaagctttcttcctctctgggtacattccaccagcagaatatttcctggacttaaaagaagaacactttg

SEQ ID NO: 2206 - DNA, 74 bp, Homo sapiens
taggatgaacacttaacacttctctccacctgagattagtcaagttaaaaatccattttaagaatgctattata

SEQ ID NO: 2207 - DNA, 350 bp, Homo sapiens
tgctattataatgacacatttataattgaggatgagaattacatcccacaatttgcactggctaattcagagactttgggatgcaaaatcaaggttatagtccagcttatctgtatctgaaattaggggagaagtaaagcataatattctgcttcatgtttccaatttcagggtgacagggtcctgttcagttgaaggctgctgtgcatttctaaatggccctcagaaaataaacaactcacagaaaagaactccctgaaagtggcagtggtgactttaaatgcccatgacccttcacactgatcagccttctcaacttgaggtgtgtggagacagggatcctggtattg

SEQ ID NO: 2208 - DNA, 346 bp, Homo sapiens
actggtttttgagggtcaccaaggttaagaggagatcgactctattacttagggaggtgacagtcactccttttctgaggtttcctggtttggattggtttgttcaagtgcattgagggggaaagagctttattctggggtggtgaaggccagctcagtccaatggctattcattacacctgcgtgttttagccatttggcttctcattattgtatttttgttttccataagtcatcatgaacacactgagtggcattaccaagtgcaaaatgtgtgctgggcatgatgaaagaaaactatataaatttcactttttagccttcaagcctttgccatttgacaatt

SEQ ID NO: 2209 - DNA, 19 bp, Homo sapiens
tgttagcaacaactgtgga

SEQ ID NO: 2210 - DNA, 229 bp, Homo sapiens
tgtgtgtatgtgtgtgtgtgaaagagagacagaggagagagagttggggaggtagcaagaaagataatgccataatcaattgaggaacttaaaaacatacacacctagcccctccctccagagactctaatctacctggagtggtatgacattcggatacattctgccaaatcataattatcacctgcaagttgaaaacacctattattttaccccaaagtataatgag

SEQ ID NO: 2211 - DNA, 386 bp, Homo sapiens
cactgtgggggaaggtggcagctttgttctaggcctaaaggaaaaaaacacgtattttcatgcctcggtcacagggcaaaaagtaggtgtgagttaaggttaacaaaataggccaagagttgttcattcatcctagtccttaaactaaaagggtgaaaaataatcctggaggtttatgtgtgctctatcccaagtcaccaaggtacaagagacggcaacaaaagccctcattgatgataaacacgtttgctgggattgtcctctgtgctccgcgaatccatcagggtgcttggggtgatgagagttgaccggtgaaggttacaggggcccagggttctaacaattatgcatttcagacacattagaagtcaagaagacaccaagca

SEQ ID NO: 2212 - DNA, 299 bp, Homo sapiens
atgacacaaagcagcagaatcagctgcaaatgactgcaggccttgccagcccctgtgagtgccacaaatcaaaggtcattctccctcagcatagagagaagagaggactgcagggctatcagtcacctcgacctgaaataatgacactgtcggtcagcattttctcttgatacctgaggagccctctctaaaatcatgactgagggctgagcatagaggtttttgtaatggaggcaacagcaaacgttaggttgcaagggctacctggttatccatcaatgagttgcagatgaagaata

SEQ ID NO: 2213 - DNA, 339 bp, Homo sapiens
taataacaggagcagattctggctcagggctgggccgtgagtcacacgagggccagcgtgggtgacgtcaaagcctctgctttgtttcactacacctgctgaaggacacctggtgtatcacagtggagaagaacaggctgtggaggctgagcaatccaacagggagaaaaatacacacatgcacacacacgtgtgtattcagattagatcatacactcaaacaaatcttgacccccactcaggacactcacaggtttaccgaaggaggcagaagtgaaaataaacaatcaaaacaaagcatcttgcaggctatgacggaaatcaggtcaataaaaatga

SEQ ID NO: 2214 - DNA, 114 bp, Homo sapiens
tggttctcatttggaggttgcactgcacctttcccgcaagggggtatcaatgcattgcatgattttgatcgttagatgacaaggaggtgttgctggcatgtcccatggccactg

SEQ ID NO: 2215 - DNA, 45 bp, Homo sapiens
tcccaggagaaagaaccaggcgctagttaataatgtcaaatgctc

SEQ ID NO: 2216 - DNA, 120 bp, Homo sapiens
tagtgtcaactgctaaggagagggggctgggaccacccaccccccccagccccaaggaagtctgccatagctcccctatttcccataacatagaccttagcatgctgttttctgagggct

SEQ ID NO: 2217 - DNA, 224 bp, Homo sapiens
taccaaatagatgactgagctgcaaacaggcaattattcatgatctctgtcagagcatttagagtggaacagtgagaacaagtctaatcacaattagctgaagtgtaaatgagaaatgagaaaaggacgaaatcaggcatataactttcttcaaagaagggtaagtaattacaaggtactctagggtttagtttgagagagagacagagttggcaggagttgag

SEQ ID NO: 2218 - DNA, 712 bp, Homo sapiens
gtaaagttaattcttcactacacccaaggtactatgttgataaagaagaaggatagaaagcttgaaaggaatacagttttaaatagtagtatataggaagcaaaaaggtggtcaatgacaaagagcactgcataataatggaaggtggccagttgagatgatttgccttggtcaagaaagagtactgatatgactgctgttcagactaggtgcttctcataacacagccaaaaagctgtgcattgcattttcatagaccatgaaataaatgactttttctggagtagtaccacacagcattgctggtgccttaggtggctcccacaacagaatactacctatttcatgagtatgcctgctccctaagtacaactaatcataggaagcatgatttacgtttgcctactgtaaatgtcaagtttggccagttcggatggactctcctaaatcataccaacagaggctgagtcaaatcaataaacatttcttaagaacctaccaagagtaatccattatgctaggctctgattacaaaggtgaaaattatagaatagctaccctcaactagttcactagtgaggaagatagcacatgaacaacttgggattttataaagaaagcacaacatttaacttcttttaaaaaacttactatggaatgaggcataggtgatgagattcaggaagacatttcaaagatttattcaccacca

SEQ ID NO: 2219 - DNA, 1252 bp, Homo sapiens
ggagatgggtgtataacacgatggcaggacagtaatggaggtgtggtggaagggatgaaggggttttcctaccaacaaggctgtccagtgcctttatttgtcagtcaaagcctttctccagctaatgtcaatttgcatttccatgtatcttaccttgtccaaactttatcctacatgacccagccaggccttcagtagcagatgttacacataaagttccttttgcccaaagagtctcctgtgtcctctaagtagcaaatcctccccacagcctgcacaatggctatcacctatcttgcttcctctgacgtgcctggacagtcaatccttctgccctgtgggcttctttgttacttggtttactcgtctgttgaagctacctgtgcacaaaggtggagcctcactcattgctcaatcagtagctcccagcgtagagctcagggttggccagtcattccacagaccactgggaatgaatgattgttagaaggaattagtgagtgagcatctcatcgtgccactgatctagctctcaatggactcatcaatgaaaggactgcacagagactggtggatgagattagtggctctcactggggatgcccaccagtggaaccagagggaatttggggaagtctgggctcacttagaattaaaagaatcagcctctctgggtatttttaggggacagtgggatgccaccctctgtgttaggaatcaacgtctgggcaggtctctcgaagtcctttcattttgtacatctaatgaattctattttgttctgtgggtttcagcctgaaaaagtggtgctctgataccaggatgcattgagccttccctgagcggctgccccaattagcctgagcagtgacatgcaaatccccgagatgttttgcattttttctggcatggtccttaccacagcctgctctgtgttgtctttgtttgtgttaagagctgaatcccagctgtttaggagtctcaacagccaggggctgatgtactcatttctgtttctcctgcagacctagttagtaactgactcacaatgtgtcctctgttcactttttgtttgctttttttctcattgaaatgaaattgaattcatctgggtagtgccctcctacccttagttacaattttgacctttagaagtataatcagctgtgtacaaattttcaaattaacaaattaaccgtttatctggaaaggttttacagcccagaagctccaggtaaatgctacactgtta

SEQ ID NO: 2220 - DNA, 653 bp, Homo sapiens
atgcaaccttattttttatggaagtgggcacagcactcccagtagcctgcagtcaccgctgggcagtggggcacaagccaggggaagtaatcccattctctgagcaccatgctgggtgcttccccaccatcagcctgaaaggagggtgctaatggctctcctctcatagatgaagaatttgaggctcggggatgaaggtcactcctgcttaacatgtgttctggtgatgagaaagccccctctttgtagagaatccctcccccttggcctcatcctcaaggccattgacttccaagtagctacctggtcctattgagagagggctgtctttggattgctaagggtcctgggatggtgagagaagtacacacttggaaaaggatctacagacacctcctgaaaatgagccagaaagagccctccatgcagtcggagaaggatgaatccatcatggaagaagctagctcagttttccttcagtttcagctcctgacagtccctgcattcagtgctgcactctagatttacccagaggctgtggttctccctcacacccaactctttctccatctcagactttgctcaccctgtttcctcttcctggaaaggcctcctgatatccttggctctttctggctggtacctcttcacac

SEQ ID NO: 2221 - DNA, 47 bp, Homo sapiens
tggggggcggggggcagggggcggggggtgcagggagagagtactaa

SEQ ID NO: 2222 - DNA, 137 bp, Homo sapiens
ttaaaagaagatactcattaaggtccactcacaccttatctggtgaccccatcccaggtgagagctggtgagggtctcctcctcagagggcccaggaatctgtggtttcccctgtcccagcacagagcaggatggag

SEQ ID NO: 2223 - DNA, 1169 bp, Homo sapiens
gtttacttttcagctcagtaattcaccatgtggctcagtttctccatttatgagcttgtctctagggccctggaccttgtgagtcttcatgaggacaggatgtggggtgggccagttgtcacgtggggctcctgccaccaggcaaggtcctgatataactacggttatagttgcggtgtggggcaagggctccccaactccagatgagcagatttgggtcaatttcttaatattttttaagggctgtgatgtatcttggctataaatggtcttttctgcacctggggcattttcttttagaaatactgctttggaagtcagattaagatgcgtttaaatggaacatttaatgattgttttaaaacaatccaggtcatagcatacaaacacacacacactgattctgtgctctgtatcctacggcctagaaccaagacttgctgagtgagtcctcaccctccagtttagaggaaacaggtgaggacgtggccaccacaaagcaagaggacagggcagggcagaacagaatggagggcgccctgtcccactgcactgcactccggggctcctacaacccattcaaatatgaacagtaagtcgctcaccaagggctggatcagccactgttcccagctcccacccaaacattcctctacaagtatttcctctcagagaaaaaatcaaaaacacctgtaactggatgaggggaaatgagtgtagatttcagactaaaccaattcagaccctatcatcttcccagactctccaatctggcaaagccctttgagagtatttctgtgaaacccacttttcttaatatttattgtacccagatctcccctttggaataccatcagacctgcagtttctttccttggggaaaggcaggacgcacgcacccagcaatcagacacatcctcagggatgcctggatctcctgaaacctagtgggtcctgaatggagctacctccagatgagaagtacaggccaaggctctgggaaggaaggggcccggccactcacacatctaagtcagcgggaggcttagacatgaagccaggaagcctggtgcctatctcatcagagagagaaagatcagttaattcaccaacaacacaaccattgatatttaatgtggtgtccaggttcagggccaattgtatatata

SEQ ID NO: 2224 - DNA, 23 bp, Homo sapiens
gtatttttaaaatagtctttttt

SEQ ID NO: 2225 - DNA, 28 bp, Homo sapiens
gacccagggccaattgtttgaagtggta

SEQ ID NO: 2226 - DNA, 266 bp, Homo sapiens
agaagagacactaggagttgaggtcctgtggggaggactggctgggtttctatatgacaacctgttttagtgtctatccatttttaatggtgagatgacccatatgcaggggctccaagttagctggagaggacagggcgagtatctggtggttctttctactttagaggcaagggctggccaagtctgcctttttcctccttaccgagtccttggcacatttcttctgaaaacaacggggatttttggttgtttaatgtattagt

SEQ ID NO: 2227 - DNA, 1521 bp, Homo sapiens
ttcaagctgtaggactgtgggatcttctccccccacaaagctatacttcttttgtgcttgactcatctgaattcaaaatcttgaatatccttattctcatcccagactcaaggaaagagatcctcatgatactcttccctttgatgtagggtctggggtggagttgatggggtgattggctgggctattggtggtgggttattgacggggcaattggcaaggccaggcatcccataggcagccttgaggggatgtatgtgttttatgtgttatccttcctgacccaggttcagcctgaaccttggctgagagcaaggcagagttggagcacaaggcggtgcccaggaggacactggaaggctggagcccaccccaaagataggctttggagagcccagagagcaccatgttccagggtcctcccaaacggtcttcagattaccaaggactgttacgtgggagaaagtatctgcactccatgagcttccagtgcgctggacaaaaaccagtgttcctgagtcatagcttgtggacaacaggagggggctgtggcatcatgagccactggaaaagggactcgggtctggctagtgtgccagtcccgacaggtgattcagatcccaattaggaatttaagtataatcctggccatgtcaactgggaagccttggcttgggctgggaaggagggggctgtattcatgccttaagctcacttctgctatgtagacaccaggctgagggcatggagacactagggttctgcctgtctgtggtagcaactgacttatgaaatgggcatggctgatccttcttgggcagggctcctgggtctaccattgagtgagctgaaggaagttagggttaatttcttttttgtcactctaagtatcttcccatttccctaagctctgggctttggggttaaactactggggttaagtaataagaaaggagtaaattcatgagtcattctcatgtctttctgttgtcctcagctctattagtccccagtaagtcctccttaatattcccagcattattgaggcagtttaatggctcctatatttaaaagggacagtgaacttgccttacaatcattcttacaagatcctttatgaatagcaacaatgttcacattacgatttcacattccgctttaataagaatggaattgccatgggcgattctgaatgagctggtcttggcttctaattgctgtaggtcttctggcagcatcctgctctatttcctggctcttcactagattaaattaactttcctcacagttcagcccttaacccttctttgggctagcaatctggagagacagatcaaaagattacagaatttttggcactcaagggtccccctgaccccaacaaagtgcagaaatcttcaaaatggcagaacagacctatggatggtccaatttcaacttgaatctaccaaggataggtcccctgttttagccccagatggttcttttgctgagtagctccagagaactccccttaacatt

SEQ ID NO: 2228 - DNA, 421 bp, Homo sapiens
aacaggtgcttaacaagctattaattatatttgtgagtaatagtaacgccctggcagttactaaagacagacttcttcaagatctattccaaaccacttcaaactcacctttacaagaaaggctagaaagctcaaactaaaacaaaattaaagaaagctgagattccctgttctctcctgcatccagagttctgtgtgtgtctcagcttctgccagagattggagcagcagtgagaaagtggaggtgatggcctcgatgggataactggatctttctggcgggagtggtgtctgcatttcctggagtagtccctgtagagtttctagcatctggttcccaagcaccacagaagctaagtggatccccagtatgggattctccactggagtctcagctatggttaagcatctttcctgccta

SEQ ID NO: 2229 - DNA, 94 bp, Homo sapiens
cttcttttaaaatctgtagcctaaaaccatgatcaacgtaattgcttgtaacaattcctccacttctaagagctgtctaaaatgcttttctaag

SEQ ID NO: 2230 - DNA, 54 bp, Homo sapiens
taaaacgctatttggagcagcacagaccacacctttgtgcagagagccagcaac

SEQ ID NO: 2231 - DNA, 438 bp, Homo sapiens
gatgacatggattttcatatcaccccttcataatcctaactaacttggagtgattttaaggtgattagaaagggaatgtaaaatggcattggtgcctcttctgcacccagtggtgctcgctgggtgctgaaacaaaggcaatgttgtgcaaatgttaattctctgagactagatgaaggcttcactgtcaaggacaaattaggttcactatgagcacagagaatggctaccttcatggaacaaatagtatcttctatgcatgtagaggaaggactcctgccattccttcccaccctttcaccttcttcccaccatccaaccaactcccttatataggaggacagttgctaatataatggatctggtcttgtgacttggattggaccaccttttaccagtgcctggacagggactttctgttcaggggccttggtgaga

SEQ ID NO: 2232 - DNA, 925 bp, Homo sapiens
gattgcaacagtatgggtcatgaattcatgagaaacgacaggggtgctgaataccattcatgtttgtagaactacaagtagattcagatgactgagagtgtggtgtattatagaaggagacggccagaagttggagcagatcatatggagctctgagtagctttaaggcacccaggtgttcaatccctgttacccagccaaaccccatatgtaactaaaactacatggaagtcctacttcaacttctccttacattgccctagcttctctctaccttccttcctctccagtctctgattcccttttgatgccttttcccttcaaatacacttagcatggtgattttaatgggctttcactcagacccaactatcaaaggtagatgaaccctgtagacctatatcctactcccattccagaatgtcacacaaacgaaacacctactttaaccagagtccatgcctgtagctttcctatcatgataacttttgatggtctgagcacccagtgagttagtagtcatcagcctctttaataggttcgggaggcccagagagacttggcaaaatggccagggttgctcaaagtcttagtagcagagcccaaaatcttgacagttgtgaccctaatgatggtgctcctactgggttgggggtttattttatcttcctcatccttggccttagccaaatgctcctgaaatctatggcaatgtcctgctgaacttggccccacagaataagtcaggtctggtcctgggcttggttatctttcctcttgtggccctgagccccctcatgttgctggagagctctaaagaacagcatgaaaaaccgaggttgctgttagtgggtgggaatttaatgggtttggttggttggtagatgatagcagaagccttgctggaggatcttgcttctgcttt

SEQ ID NO: 2233 - DNA, 58 bp, Homo sapiens
acacagcctggcttagctctcattgctcatgggtctttagtccaagaaatggaaagcc

SEQ ID NO: 2234 - DNA, 97 bp, Homo sapiens
gtcctgcaggaaggccacttcctgctttcctgggtccacccctgagcttcagccatgcggtttctgagctgatgagggccagaggccaacatgaatc

SEQ ID NO: 2235 - DNA, 200 bp, Homo sapiens
caggatttggaggtggtggcaggcatgccacaagcagccagctctagccagtggtagaatcagctcatcagctgtggaggaaagaatgactttattcccaatggccttgaatcagtttttccagaagtaagctctaggtctcctttcatcctcaaaccatatttcatggacagatatcatgattcttattttatatacaa

SEQ ID NO: 2236 - DNA, 927 bp, Homo sapiens
tatgtttcctctctggcaagggctgaattaaagttttataagtatgcatgtattttttcaaaagactatcaacaaatgaaaagttgaaataatctttaaaaaagatttctcagctcaagactaaaaatcctgatttgaaaaattaaagtcatagaacagttgcagaggcagtcattaggtccttcaaaatctcctaaacttgagagggaacagctagtgagagctaatagagatgcttgcaaaggtgacctcaggcctttccagagattagcccaaagcagataaggataaaatactttcattaaggcaattagagctagcatgagaggaatgttcccaggagacatcacttctgggacactttagctataagccccaggtgtttgacagccacagtaccttaaagcagagaaagagctaggtctatttctaactgcaaaagcaggaaaaccctccattgggttcagcaaagagttcatccatgggtggtctattctgatatcagatgtaaatttttttgtattccttctcaatgtctgatttatccagcggcatatcacatgactaaacacaaagcgagtagagatgagagagttaccaagtgacgcccaagggtttatagacttgaggccattctctgaaatcatagaactctttaggagctattatactgatatctgtttttagatacaatctgggcatggtaggtgatagccatgagagatgggggctagatgatgggggcccttgagtggtgtgctaagataattggactttatcttatgggcactctcttcaaacagtttgaaggggtagattgatatcatcagaatggcattgcaaatggccaaaccagtgaagtgtggaatgtggacagagggaaaccaggctggaggaagggagatagtcaaaaagtaggtggaaaag

SEQ ID NO: 2237 - DNA, 628 bp, Homo sapiens
gatgtgatttcagtaatcctattgggaaaagagagtaaagtcttcaccaaattcttaataaagtgaactgagaggagaggatggatttgagaaatgggataaagttgggagactttggtaatggacaaaagtgggatgtgggggcaaaaaagagtgttagaagcctgcagttttctggcttggggacttggggactctcactgagtgtgatggaaacagatttggggagatggtgggtcagggtgaggttgggatgcccttgaaacatgcatgggggcatattctcatatcactgagcagccaactttctcctctgcactgtccctttagcatgcactgttctcttcaaaccagaatcccttccttccctttcatacagttaactctcctgcgctttggacccagctctacctcacttctccagtgaagactttcctagacccagctaggccagtcagattcccaggctctagtagactgcctccttctcttctagctgtagatctcaattggcaatgggccccttatgtgtggttcatggattaatgtctacctccccttttagagagggtcagctccataagtaccaggagcatgtctctttggtagtcaccactgactcccagta

SEQ ID NO: 2238 - DNA, 84 bp, Homo sapiens
tttgtttttaccaaaattcagggattcccccctaatcccaatgagaataatgtcttaaataaatggaattaagaagcttcaaaa

SEQ ID NO: 2239 - DNA, 750 bp, Homo sapiens
caaaactctttaaagtactcaacctatcataagactagtaggtgtttctcaactctccttctcaaaacatgagatcatgaggtcttaatgctgaagattatggattattttatgtagagaacatggaacaaagctggactgtgctctggctcaatcagctccacttccacacctcgcagcaattctcaattatcaccaccagagagaagaaggcagtccctacctgaccatcgcctggcctggctaccttatctgtctaaacagtgcattgcaggaggccctttcctttctgtgctgttttattttttctcccccagcactagttttctaattagaataattgaggagaaatacaagattttcacagaatgaaagcaaaagtcttccaagtatgagaaaaatagaacaaaggctgtttatatccatattgattatagtgggaaggtattattgtaataaatgtgatggttattaaagcaagtcttgattttaaggaaatgttttgtcttgggactgtgacaggagattatgtgatgttcatgagatgatcatactgtctctgtccaggtctctgtaacatgtagaacacaaccaacgtagagtttcagtcccatttgatttacagaaacagcttgttcctcagtagtattctatatataaaaagtaaacacacacactatagttcatagagaatacattcacatggattactaggaaaactaaagtagcctttcaaaataattaaaaaag

SEQ ID NO: 2240 - DNA, 1004 bp, Homo sapiens
taataaaaatgaattcttctcaaaaaactacctttctattagatattttttatctccaaacataaaaggtaaattttgaaataactaatagttaataagaaaaacatgtaaatagtatgtaactagaattgttaatttcttgaaacttaaggtttgtttttatgttatgttagcaggatatgtaaatctaatgacattcaaaaaacataaagtgagaaaagaagaggctggtattgaacatgtatatgtttactatattctaataatggtcgagttgtttaatttctgcatgaatgtctaggcttcactattagtcttcagctaaaattctgcccattttggtgaaggaactgtgtgtggcacataaggagagcttaatgttagtatttaccatagccttactaatataatcctataatattgttctccatgttcccaaaattaaaaagtagtctaattctacatacgaactcaaaataaatgtatactgttatgtggcataactcaaaatatttagaattaaacacagctcttattttctcacacatactgagtatggaattactattatttttgtttccttgatcagaggtagatgaaacttgataatatagtcactgactgaagggcattgttttgccaaagttcgttaagttaaaaaatattttggatcaataaatgtctttcattaaaatattcacctacataaaataagtattcagaattgcataggacatatgaatgtcatctttcttttgctgttcatttacccaacatttttcttctttttatatgtgccaggttgaaaattgtcatcccatactcttttcagctaagaatatttctgtgttgggaatatcttgaatttccctcaggggttgatgatattgcccacaaagactttaggcaattttgatggccagaatgaaaacaggcagctaagatatttatttttaaaagaaaagaatagaaaactttgtaatctagtcatacattgtaggaag

SEQ ID NO: 2241 - DNA, 154 bp, Homo sapiens
tgccccactctggaagtaattattaataatgtttctccttccagttcttcagtttgttaagcgcaactgttgaaaacatttatttgtcccaggagattatacgaaaaaattaagtgaatctacttaaacataaaattcccagttttagaataga

SEQ ID NO: 2242 - DNA, 441 bp, Homo sapiens
tggcctcccaaagtactgggattacagtcgtgagccaccgtgcctggccagattcagatttttattagggatgtcatttagctaatttaatgtatttctatgccatagttcatattttctgtgctgtaagtattttctatatgtctgatttatgttgaagaatagtatctctttagacgcaggggcatactgtgagcatctacaccatggcaaatggctttgcattttgcactctataccattgccaaaaaaaggtttgattatgctactaaaaatccgacatgaatcagtgaacaccgaaagccaataattttagaatcccaaaatagtggaatgtttagaactgtgatattttcagtttatttcctccatcaattttcattagaaagcgagtaaggaaaatagtagaatttaggagttaaaaaatcaaattagcggtca

SEQ ID NO: 2243 - DNA, 1106 bp, Homo sapiens
caacaacaacaacaaattaacaccttgcttattataataaagaacgaaagtaatccaatacctgtaacctagagaataaggttcacatcacttaaaatggcattatatataaaagaaaagattggttctactacatacatcaggcttattaagtcacactagacaactgaggttgcctaagacgtcattgtcctggacttgcaagggcctccaactccagttaaggtgataagaaaaaatgaaaatgagcaacctagcaattttcacaggcctcaggaaactggggccacatcgaacccagtcacaggttataccaatttgatttacaacaatgaaagaaccatctgcttatacttgagttacagcacatccctttgtagacatccatacaatagaaagccccagaagttgattcacagtagaacaaagtgtttgtgtcaagcaaaggaaattctgcacttagaaattttatcggcacatttgattaaaagatggtgtaggtaggcataagtaagaaaaccataagcagacatagtcaacatactaggtaagtaaaaccaaatccagaaggttgtatttagtaatattcatttcagatttccttggataattgtggtttgccttacatcttttgactatgacatagagattttattcactttttaaaatatctcctagaatgtagcttgagtcagtcaaacaggaaaacatattgcagcattctctcttttacctcccccaaagcactgtaatatggcttttggaaatatttcctcattgtcctttagtttttggaatgatgtctgagatactgctgtatgtaaatacaatgatattccatatttcctgtaagtttgcctattcagaaagctgcatttacatacatgctgaaacacaatcgctggtgatgtatcaaccagaaattttatgtgtgagcctaaaaggaagtgttgagtctttctctacttaaataattagaaattaaaagtacctcttctgcattctacagtttatgtaatattaaaagaaggaattttggcaaagtaactgaggttatcagttcagttcagtttataaatttagtgacatcaacttgtcccagcaaa

SEQ ID NO: 2244 - DNA, 3353 bp, Homo sapiens
tgggcctgtgttgaatgaggataaattatcttttctctaaaatgccacatgaaccctctctatattcccacatgaagaggaatggaaggtaattatttggtcttttcttctgtttaggggaatgaactgaaccactcatttttttaaaatcacacttaaaagacacatgggcaaaaaagttccccaaaactactgtcttaccgaatttgagaagggaggtaatgtatgaagcttaacagctggcttcaaaagacacctttccaaagaaattgtactacctctattaacgtgtaaaccaccaaccaaaaaaaaataataagttactccatcaaacacgttattatccataaaaaagacttcaacattgtactggaagatctatttaagcataaatagtactaagcaccaattactaatctgaaggcctcctcacaggtccaagggcaatgagcaacctcaagaggcaggtgactgcacaagcagtaagctatggattaaaaattaaaaggatttcacattctttccaaagtgtactgcccggtgtctggcacacgcatgttacaatatgacaatctgctctatttgtgagcacctgagtgtattacaggggattacacatgcatatgatagaatctggctcccggtacagtcaaaggagaacagcatcagccaccaaatgtgctgatcttacactgaaaagggttgactgaaaacatttcaagggtaatgtaaacacaagaataaagctgtgggtctattacttagtgatgtggttttatatgctacatacgtagacctctctttatacaatgaatatggacagtgctgcaataaaaactgatgacacgtcaaattgttcacctgaagaaaaaccctattatagttcagaaaataatgcaaccaattttaatttaatctagatacaggtactttatttacaaatatttagattaatagcattttgttacatcaaatgaagagtacagcagtctgaataaatccttcagtcacaaaaacaataaaacccactgtaactaactttgggagtcagggtattgcacctcaacaagccgcagtctttagtttgtgattgctaccttatatcccaatgggtggtttgtttgttttgtttttgtaaatatacacacacaccagcaggtcatggtccctgggtgagtcccttgtgatgcaacagtgtaagcaaaatggatcactgtaagtctttaacagaatataccaatctactccagaaatcttattttttaaaaagttaaacaaagacaaaaataaaaatgaatccacaaattaaccaaagcctactttctgcacattccagttttggcttttatttaacattgactatacaatactctggtactaccacatgtttacaacccagaaagatgtacttttatgttagtgtctgtaaagagggatttaaaatgtgtattttaaacacagcagttgagctgagtgcattttctatagtacgctgaggtgttacctattctatttcaaataaattctcaattcccagccactgaatcataaatgcaataaaaaaaatcaacagaaatgaagaacttaataaaacatgttgtccaaaaaaataagattgtttctcttgctatacagtattaattcagtggccaaaccacctggtgcaaagtaataacttactttgtatcagcacaagcgctgaaacacctttagaaacactttcccttttacaaaacaatttatgccaacatgacataaaacagcccctcacactgtgaacacagggatatcttaagttatttcactgtagggttaaaaatgcacaatttaaaatcccttaacagcagacctgtggttctgactgtccagttcagaatctgaccattccaagaagataaaggtataaaagcttaaaatgtgcaatagtaaacccagccttttttctttttctatacagtaaggcaagaatgcagcctgtaatgcaaaaacgtttacaaaaagagaaaagcaggttagcacattgtcgattgcacaagaacagttaagaaaatcagcaggtaagcaacagtgcaaagatggaacagaatctgctagtgttaatcctctgatgctaggagctctttccagcataatgtccccaaacactgccagcaccaaggggtggagccagtactacttgtgaactgcagttgtgtctatttctttgtgtgaaatggaagggagtaacatggtcacatataggtcatactgtacaaactggtattttatactgttccaatgccagtaatcaatttattttcttcattaaaataatatacacagaatgtattgttagttcgattccttcaaattttatacatatttactttctgttaaagagaaaaggataaaatggtataaaaaaagataaagctattaattaagcacgagagagaagataaatggatattttccctgtgtgaggctaagacagaagcaaatctcgttaagaaaaatgccacccacacaacaggaaatttatccaaaacaaaacaaaagcagttatagaaccccttctctaccatcagaagtaatttcacagcaataaacttattggttacaacagacatacttgaacagttaaggatgggaagaaaggcttaagatatcaccaaattaaaccgtacagtgagacaaagccttgccaaagggagggtaaaaatcatgaagtccagcatcagtgctcggtttaaatcatatattggtgacatacttatcacgaggacaagggggaaaaaaagtctagatttaccatgcaggagagatttattactctacttgcctttgataacctgattacatctagttgtttagcagtttagtattgtgttaaactgtttttacaacagagttttttctttttttttaattaaacccagtaagatgtacagaagacaatgaggcagtaaaaagtactgcttccaacagacagaggtgaaaggtcaaatgaggggccacagcaaagaggtcactagcagccacagccttctctctggggttggggttcactggttagccggcctccctgcggggctgaaggtttgtgttgtacaccagactcagcagcattcagatccaagcttccatcctgaatgttctgatagattttcttggcagcctcaaggaaggcatcttctacattctctcccctaagaggcaattgataactttattggagaaccacagttttctacaaaagacaagacactgaccttttgctaatctttagttaactgccatgatgtctccaacttaaccactgtcatctaataagagattaccagaacactgagctaagagaacatggaaaacta

SEQ ID NO: 2245 - DNA, 1571 bp, Homo sapiens
atgagccaccacacccggccggaaaactactttctatggaaagcatacatacatacgtgtactgaaagccctttctacaaaccctatttggacaactacatgtgttatatgcaatcattaaaatactgtatgttaatacacaccatgacaattcagataggtcatttctgtgataacagagaggatactccaaacagaaatgaaatctctctgaacatgctgaaaaaaattccaagaataatatggtctgctcagccaagcatgaactgagctgtttttaatcgggtaatggtgacataatcatgcttagccacgttaacacctccattcagttttctttggactaatagcacagctgagactaaacgaaaacaggttagcctctcctcaccacaagaaatttttggcctaataaatgaagaacaatgatgggtgtaccacagttcaatagcagacatggaagaacaattagaaaatgttcactatgcttctgagtagacactattcccttaaatcatgctttttaatgtgatcagaagtattacaggaagaacagattgaccaagcttgtctgagatgccaaactcaacctcacttgtgaaaagtcaaacactgtcatttgggaaaagtcaaacacttttgaaatgtaaacaaagtttcatttattaacctgggttaccaacaggcataatcaaggtacaatcttttaagtaacaaaaattcatattattttgaaatgtaaaaaaggaagcaaagagatgtttgctgttcttcctgcagtaagcattacacatttatagatagtactttatatgtgtatatacattatatacttttcatatatacggttctactttgagaaacttgaatataattgaaatatctgtattttggtcacacttacgtttttgcactcgcttcgaggaacaataagcctaaaaataaaattcagactataattaggacacttcaaactaactcacaagtgcacttctttagtaacatctgaaaaagtttcccatcagtttttagtactcctcccatagtattttatgaaaaagtatgtaagtttgaggtggagagcatctttatatttgtcactaaataactgtactgctccaacataaatcacacagaaatagaaacacattgttacttcctcattcttgagatttctgagtctgcatttaaaaaaaaaatgcaaaaaaaaaccaacaaaactgtcaagcccacctttccttaaaaattctcccaattgtgaccattaagtcttaaagaaactcaccattttcttcagcaaactgtttggcttcttcatatgtaacatctctctgtgcctccaaatctgctttatttcctatgagaattattacctaatttgtgatcaaaagaaagacaccttgtaacaaaagcagtaatttaaaccaaccatgcaaattctgaaatccaaaaatcttgatagaaaaaatgactgggcctaaaaagaaaaccaagtactagcaattatccactagacagggctacagattcatgaagtcattactacaaaggaccttagcaatgatctaggt

SEQ ID NO: 2246 - DNA, 42 bp, Homo sapiens
gtctagtccaaagattacgatatagctgagtaagattactaa

SEQ ID NO: 2247 - DNA, 1116 bp, Homo sapiens
agaaacccaaactgagatcttgagacaaatactatcctaccccacactatccctagaaaggattgagtttatagttaacagtaactgataagagatgtctatgtgtatacacaaggggcagctgggagtaggggtttgggggcacgtatgcagtaagttcaaatccaaggcaaaatatcacccaccaacctatatccaccttggaaccattcatacaagtgaagttaggccaaagttaaaggcagctctgcaaagttgtaagaaaaaaatatgtacccttgggaaacagcaaagggctttggcctttacctggggtggggaggggggttatggataaactgtctttgtacatttatgagcttatttgacaccaactggtaaaatccttccctttttcccccttccaaacagatatggtaatctagatatgaacactttaggaatggatggtttcaactaaaaggcacttcagccattaactttttttcatgtaaaattacagctcctggctcttccactttcaaaaatgtgtgtccataaaccaaataatcatttttatctgaatgtaaacctcatgcaaggacagttaagtagtacaacaaaagtgagcattctttaaacagtgtggacaaagtgcccactgtgaaggggaagaaactttcatatactatccattagtattttaaaagaataaaataatgatacttaaaaaggaaatcaatttataaaaaatcaagtctggtaaagccacaatgactagcatagggccattacaagataggtactcaaaacaagaaatactgccctgctcctgattccctatgaatctccaaataaggcttcttatctccctgaaagggaagacataaagtggcatgctaattacagagatacaaaacatgcccacaacaaaatggtagagaacacaacttctacacagaaatcaagggcaattctatagaaaatggagcacttaagaaaaactcaagaaattttttttctcctgatctggttctatttcaaagcacataaatgaggcaggaaggacacagggcggtaaggttaattttattatactcctccacgggccctctacaatgagttttgtttttaata

SEQ ID NO: 2248 - DNA, 154 bp, Homo sapiens
cttgggtttaatgcgataatggaaatgaaagtttcaggcacagtccctagcatgataggcaaacaatgttaactgactctcaatatgattaaaccaccatttcctgataaaagctcatcttaccactgataacacagttcttgaaggaggcctc

SEQ ID NO: 2249 - DNA, 93 bp, Homo sapiens
catctcagtctggttaagaagctaatgttttaacacatatagaatcctttttatttttgactgaaatttttatccttaattctcctcctgtag

SEQ ID NO: 2250 - DNA, 398 bp, Homo sapiens
atgcagatcccttttaaaatcataatttcagatttcatagtcttcacatgagatcaccactacattcataatagtaatgacaaacatgaacaaaaaacctaggtataataaaatgcaaaacctggtttaataagaactgaaaaataactgttaggttttcttcaactaattgaagaatacaataaaaattctctcattcttagtacctgaagacaaaaatctcaccagtaaatggcttccctttttgggttagcttagttcttaaattttctgtgtaataagatgccatttaacttacagtatttggattggtgagattccttgcatctgtcaaccagctgcttaagtggttatatgtacttcttctgcaaaaataaaagtttaaatttgtgactgcc

SEQ ID NO: 2251 - DNA, 761 bp, Homo sapiens
aatacatatttaatcaacatatcctaaaataataattttgctttgaccagttactcagaacagtagttgtgaaatacaactgcatacttttcaaaaatctagccaaacctaatatttttaaataaacaactcaatatccaacaactttgataattacaggtcaggagtaaattgtttactcctaaaagcataccgtaaacagaccaataagcaagcaaggaacaacacagtaaattgatggaaatgccaatgtggagtcaaaactcaaattactttgaaatcatacagactttcaatcacaaagcacaaagttgtatcaaaatgcctaaacatgacacatttaatggaagacacttttgcttgtctttaaattttaatttcattaaaaaccaagtcacactattataagctggcatacaattcacctttccttaataatttaaagagcaagctaactataacagcataaaattgactttgaagacatttgacaagaattcaagtccccagatatcagtgaaaaagttcgtcctaactttgttctcttatctatcaggcagctaaattattctggaattctaactgcccaagcaagagtttaaaaactcataggctcatttgcactagccaagtaagctctaagataagtaaacaaacccaaatatttgtaatatcatacacagtagaatctaccaaaggggtcaaagataataaaatttttgaggttaaaaatgtttctgatttatagactcacagaatgt

SEQ ID NO: 2252 - DNA, 563 bp, Homo sapiens
acttaactggtgtcaaaatcaggcctagaactcttttacaaataccacatgtcctttaagtgtttctagtttagtcctgtgaatatattccatgatctctagctgccagttctcatagaaaatctgttattcaaagtatatagttctttcccaatgagaactgaaaagaactccttagtcagacttttattgtgttacatcatattattcataaatcaccacttagatgtcaaaaaagtcatatatatcaaaatagcccctttccccccaatgttttagaattttctaagtaaacaatgataaaatacaatttttaaaaagcacaagccttatctgtgtttgatattcgtattattggcatatcttgactttatacaacaggtatgttttactacttcatgcataaaccttaaacaagtccgaacatttctactgactttgatgaactttaaaatttcaaagctgacacagagagtgaagtacacagaaaagcctagtaccaaaatcatataaaccatattacttacatgtactataacttctgccaatgattctggtaattg

SEQ ID NO: 2253 - DNA, 256 bp, Homo sapiens
ggtggtactagtactaaaaaaaaagtgctaaaatactagatatgtcaaaatgttatggcaaaacaactgtcacgacaagctacgctgtcaatttagaaaagcaccctgtaacaatgagagttaatgacaaaaataaaaagggacttttacgtttgtaaaatgtcaaagaataacagaaaaaaattgctgtcatgactgcaacaccaaagtcactataaagtatcactttagcgcctgactaaagcctcgggtactc

SEQ ID NO: 2254 - DNA, 89 bp, Homo sapiens
tgttcccagctgaagtactttttttgatgacttgaatagacacagattttaccaaaagtattaactatgcttaaaagatatgcttaaaa

SEQ ID NO: 2255 - DNA, 295 bp, Homo sapiens
ggtttctttttgcagattgaatcatgtggcttacaaatagtcaaggatctaggatttactgttcattcagctatgtggaaacacacctattacattaaacaaagtagagtttattcattccacaaatatgtattgatagctgggaataatttgttattagtccatcttcccttatgatggccactctccatcagggcagaacaggcgtggacttctatgctccacttgttacttacaagctagatgatcttgtggccaacgcttctttagaccatattttttcaaagttattaat

SEQ ID NO: 2256 - DNA, 188 bp, Homo sapiens
attaattttacatagttttctgttttggcttgatgcaggatatctaaaaaacttataataaacttcataaataatgatgaaaatagtgatacattcttattacattcagagcaaaaaaacctgatacctttactacttctgctttttcaacagtagcagtgctatgtttatcaaactttaatgtgcat

SEQ ID NO: 2257 - DNA, 337 bp, Homo sapiens
tatgctttacacattctgaggtgcccagctgcctggtgaggtagttgtagggtcaagtgatagtaatttgtaaatcataaagtattctagatgcttgagccaagaaggtaatgaagtattagcttctcaaagcatggttaattgcactacattgcctggtccatagtactggggtaatgtttttttcagaatgcttaactatggttcacccagcaggctctaggaatatatttttcacctgtttcctgtgtcatatgaatcagttccctaagtagattattccagttttcagagacagggagtttcttaaactccctttggcaacgtggtgaagtga

SEQ ID NO: 2258 - DNA, 393 bp, Homo sapiens
gctggtccctagagctggactaacttaggtttgaatctctaccaacagccagagactcctattattaagctctgagacctctttttaggtctgtgggagtgccctatatttacgtttctttcctttggaccccgtggaacctagtcttttctctctaccttaaccatacttcctctgtcccctgtaatttctctctccttgagtgtgatgagacaggaagacagtttcctcaactctccttttcctcataagccccttgcccttatgggcctgactcccagtcttttgtagaaacaaacaaataccaacatgaagaaatgaggaggtttatggagccttacaaagctgtatggtcgtggagctagtctccaactcctaagtagtttaggggaa

SEQ ID NO: 2259 - DNA, 129 bp, Homo sapiens
cttcttccagccagccccctgtgcactttgtcaacaaggctgacatagagtggacgttgtgactagatagctttcttggcatagaatctagatgaccttcctacatgccgttggatggggagaaataac

SEQ ID NO: 2260 - DNA, 485 bp, Homo sapiens
gttcccacatctaggcctgtgtggggaacatcttggtatccacagctactaacttgccctttggggctagagaggttagggatttgctttgtttcttgggggattccttatcttctggactttcttgaaacaatacttcttcttgactctggcattattctgctgcattcagcagggttccccaaatgacccaggaaaaatgtcagcatgggagagaggggagttgggactaagtctgggacagacccagtgaatctgttaaatcagaccagagtgaactgccagtgtgaggccatggtctgactgctgtggtattcatgagcagagctgagaaagtgattgaggagagtcttggtggaacagagacagtcaccacatctgtatttgtctctttggccaatactgaagccttcactctcactcccacgtgtggggttgtgagaggaaccattgcatggagcaaatagtggcatctgtacttacct

SEQ ID NO: 2261 - DNA, 985 bp, Homo sapiens
aatgaatcatgaatgaatgactcattcaagaaaaggccctccatactgctgactgttggaggatgctgtcctccttcacagtggccagttgagcattcacattgactttctgttgctgccactgtatgggccatgttggagacaggatttggaaaagtggtagatggaaggaaaagcagagagcacacactgggtccaagaagatgtggggccacggtacctctgaatgtgctgtgtgtggtggagtataattctccattgtaacttgaattgtttttgagaaaatggcaacttcctttctgtttccacccaaagggtgcatattggccttctgtgacatattgtcccattatcttctcccccatgactatgtggtttgatttaacataaatattatctgcattccagtattatagacaaggttcatttatccctgggtaatgatcttttaggtttctaatgtttcaggggttagaggaaggatgggaaaagtggttgttctcagattcacattccttcaatacttctggtgactagcctcacatccccaagttctccttgccttctgattaaatgtggttctgactctcaacatcttgttttcccagcttaagtgtaagccctctgagagctgattctgtgacttgtgctgacacagctcaggatttacatagagaaaatgatcagtaaatacttgagtagtgggcagtgtttgtccacttaatctgtgctgcagcaatggaaaaaatgaccttctcaagagggtggcaagtcctgctttgcaaatcactgagtaaaggaaaagccccgaggagccttgggactgctagcctacctgctcaataaagttccaccttaagatacaggctaagccttacctcctgggcctgcagtaacaacatattttgtaatgctgattccagaggacttgactgtggcaagcttgggtaagttaggtatcagtacatgtctttggaaattgcag

SEQ ID NO: 2262 - DNA, 240 bp, Homo sapiens
ggtttttgataaatttatgagtctattagagcttgctggtagtataaaacatggtcaataggtgccactctttgaatagttttactgtaggcattgctcatcgtactccagtacagtgcatactaagggatctagaacccagatgtttaacagaataagcagaattggcacttgagtcaaatgttttctgaaaataaacctctaaatatattctccttgacctgggtcagaactgtagag

SEQ ID NO: 2263 - DNA, 1483 bp, Homo sapiens
tagagcagtcacttttccttctttagagggagataagtaggcacattggattggaattcagtattaaggaggtgaacaacagatagtttttgagacatctgagagtttgttatactgaaaaaactgtgtcctactttttttttctaaattgtattttataacacaaagtatatttaaggagaagttgtggttgagacggggccagggagaatgggagaaaggaaacaaaaaattagataagcaaaaagatttttttctgtctattgttttcttcaatggtgtggtatccattaccatcaaacagagcacctgtaataagtcaccagggctcttgaagaaattggtgaagcttcattctcttgcagtgcttattagtgattcagtgtttgttcagcttctgctgatggagaattttctcttcagaagcttcacaagtcagaggttaccccttgctccctccaacccaattttctatgcaagaagcatctactttctctgcctaattagagacactcctcctcctgaatgacactggagtgacctgtcatggaggcaaaatgagagcacatagagagtgtgggtaagtatgtaaagacctgggcccagagggaggtacagagggcaggggcgaagtgtggagctggctatgcagaccgaatccaaatggccttagagagtagctccactttccagcaccctctctgcagaatattgacacaggcttcactttgtttcttccttgcttctgtgtctcccctctcccaccactctatcttccaaaccttccacctctcctgttttcatgagtggaagaagagagggtcaaagaactgccaacttacttgcatttaagaaagtggagccaacatgtagtgtgagaaatgtgtgggctcttcacaattgcacagggaagagcagagattcaggagaaatgacactccttccaggggctctagactgctgcatgttaggtccctaccagcccacagccagaggaaaagccagggtgaggccacttcacagggctggctctggaggccatcccagatgctgtgcccacggaggtgttgtgggctgtttctgtttctggaaacagtttcagaacctgagtatctgaggagatatccggaggaccacagtgaacattcctactccttgaatggaggctggccatggtccttgctgtggggaatgtgcctaggtttggggagatgcctgctgaggagcttgggacccaggtgtaagattcagcatctgatggaagaagctggcaagcattacctgcatcctgttctggtacctaaagggaggggggaattttcaagacttgttagagccaggggagatccaccaagaattaatgcccagcctccaggaagtctgagacatctgcttggagccagggacatttagctgctggtgtctagggtgatgctgtcaggagtgagcactgactctgaggcttaagtgtcccctctctgtg

SEQ ID NO: 2264 - DNA, 293 bp, Homo sapiens
tcttggcttagtcttataaattatacacttttgtcagatgacttttcttttgggggccatttgggataatgataatgatgactgttatggcagtgttggctgcccgagagcgaaacaggctccctatgaggtcatgagccctttgtcactaggggtattcatgtagtcatcaaagagcacttatgagtgatttcaagacaatttcatcaggaatatccaactattaaaaagttagattcctgggctgcaacctactctcaaggactccaattcggcaggcttgggatgggacc

SEQ ID NO: 2265 - DNA, 43 bp, Homo sapiens
gaggaacaaatctggatcaatgtgctgctgtagggaggacatg

SEQ ID NO: 2266 - DNA, 133 bp, Homo sapiens
agaattgagtgtgggacttttgtgtataagtggaaaaggggactcctatttcgaggccacagaagcagttccatggtatctgtggggatgccagttttgtgggttttactgtatttcatgggaggatctgtgg

SEQ ID NO: 2267 - DNA, 1314 bp, Homo sapiens
tgtcagatgctctcttttccagtttcaagattttctgttccttgaattctgtgtggatgttgttagctaataagcagtgctgatgtgagaaagatgggcccctgtgtgcaagagtagaggtggctcatggaatctctgcttggcccctgaccctctaaaagggccctgggatccctgggcagaagatgtgcccatcacagtgtaatgaattctaatttgaatcttggccagggttcatcctcgggacctcagtgtgctgaacttttggggtggcaggctatcactgagacagcctagccaggcagcaggaggaccttgagcatgagatgatgtttgcacaggcatggcctctccttgctcactatgccgtgaaggtaaaatatcctacttctcagatagagggtgcaaagtttggtacaagtgccaatgcactcaaaggataaggagtagtccaggaccacaacagggattttagacagtttctcatgcatgccactggtgctggttgaccccttcaagcaacctgcatcacactagatacaatgagaaggacgatgggggagggaaagtgagttgaccaaggctgactccaggaggttctcctcttctcctctgagagccctagccttggcttcctcttggatcatgtgttccgactgttgtctttttccaattggcctccttgaaaggttttttggggatgcttagattcattctctgagttaggaatgtgtatctgggtgcagggaggggccaatgcttaggctaagacttgtgtttcgataggtggggcttgggtgtggggatgaccccaggatgggcgtcttgggtgttgcaacctggacgggaacactccctgcctgtcatctccacctcctttccagaatcctctgtcattgtttcttagggagcttcttagaaactctgcttctaggggactggtggggtggtggcaggggattgtgcagcaggggtgggtgggcaaggatctgcatctgcaggtctccctggacctcacctgtccactgccctggcccttctcacactcccagctgcttgctctcccacaacagggaccctgtgtctcacagttttggcattgatcctaggggccagcttccttgcttctctggtgtctctgattaagttcaggaaaggagcctcagcaattccaccaggttggctgcagcccaaatctctgtcattttcttgttactcttaacaatgtctgctgggtactttgggcactgtggggtttcattcatcagcccagatcaagccgtttttcctcttggattcacttattgtctcaca

SEQ ID NO: 2268 - DNA, 208 bp, Homo sapiens
ttgccaatctctttttataccagacttctgttgcatgtatggtcagtcaattcatcaaaaagcacatattggcacatgagtcaagggagatgccaaggacacagagatgaactagacctgacctctgccttatggtttagggaggaagacatattcagtaaaccattaccaataattagtaaattacttgcaaatgtgaatgggctgg

SEQ ID NO: 2269 - DNA, 237 bp, Homo sapiens
tctaaagcaggggagcagcacacatgtgagtcccgaggaggtcagtgaggctggagaggtgacagtcatgcagcagggacaggtgcacgagtatctgagaccacagaggcatggcctttccttgcagcatgctagcatgtgtgttaatctttcctagtccttctagttaggctatgagttccttgtaggcaagggctgcaccaagagcccttggaaactcggattcattcccagctg

SEQ ID NO: 2270 - DNA, 81 bp, Homo sapiens
ccagctgacgcagggctaagcatacagagcagaaggcagcagggtggaggaggaggaactcagaatagggaggcagacact

SEQ ID NO: 2271 - DNA, 147 bp, Homo sapiens
tgaaaggatgtacatgagaaagaagtgataagaactgctcaaactagaagccccagcttaggtcagcagaatcagtccaggctggtttcctccacctctgttattcaagtgtcctcaagaactggacagtgcaggtctctgagatat

SEQ ID NO: 2272 - DNA, 21 bp, Homo sapiens
ctatcctctgttccttctgga

SEQ ID NO: 2273 - DNA, 427 bp, Homo sapiens
ttaaaaagtgtaatattctctgttgtgtttaatttcacaagccatctcccatcctttctggatgaagatgggatacatgccttcctataaaacataaattgtgcatatcctgtttacttgcagtcatcacccctgacttcctaccccaaatctcgcagctgtcagtgggacatcagtctttacttttgcctgaatgttctatcccagcccttccctgggacagcaggaagagggctttcctccttctagaggctctctgagattcatgactcaactttgcaaggccatgttgttaatccccatgcctcagaggtattcagctgcaccacagccccttctttctctgcaacctgtgtcgacgctgccatttccccgggggaaaggggaagcagtgttgtcccttgcatggtgtctgccatgtgttgat

SEQ ID NO: 2274 - DNA, 140 bp, Homo sapiens
catggcagcttctgtctgtggccatgactcccaattacctgacaagaaagatagatttgaccaggagttcctcttcgagccttgtttctgagggctgcaggtagtgagaaataacacccaggacatttagaactggaatc

SEQ ID NO: 2275 - DNA, 325 bp, Homo sapiens
aacttcaccaacgagctgagacattcctatttaggcttgttttatgttctaattcccaaggacatatttctcatggactgtactccagagactctaattatttcttgttagtcaagaataattttaccaagcatctgtaagctatgaggagcctgggatgtgtgtgtgttcagttttggagtgttctgggaattcagtttaactcaagcatttattgagtgttcacccttgggatgaaatatggtatgcaacatgggatttgcagttggaaacctgagtttcagtctgagatttgctgttagttagctttggccttgggcacaca

SEQ ID NO: 2276 - DNA, 200 bp, Homo sapiens
tttggcatcagcttccctgattgtttacagtggggaaagtcagtggatgaggtattgagaagtgtcactttatgcccagcatttttagcattgtatttaaaacaaggttagagcaaccacatcagatcatttgtatgtgcagttatacaagccctcccagaggtaccttggaaagaatagtacagtcacgtgttgcttaa

SEQ ID NO: 2277 - DNA, 193 bp, Homo sapiens
ctagttacaaatttaagattcagtattcaataagtaggataaataaaaggggagttttacaattgaaagctgaaaaatcatcagcaagatttttcatatttatttcctaaatattctaagtgggttttcttaaaatacaaaacagcattacttataatcagatagaagcttggagtgtcttctcacagcaggg

SEQ ID NO: 2278 - DNA, 366 bp, Homo sapiens
atctcaaaaaaaaaagaaaaggatgctgaggccatgcatagccttgcagaaggatatggtgttcatgtcttccaattgataatatagatactgctgcccatcaaacagaataagtaatttttatagtttccagacagagctaaatattactatcccccataatgataaacaggtatggcagtaagggtaatttttttaactctgtacccctcagacctaaacattgacatgccaaaggaatttaggacttcctgatctccatctccatcctcccagacttggcaaaactttacttctaaacacataaacactgtccacctccaaggaaacatattccagagacttctacctcaaaagtcagtataa

SEQ ID NO: 2279 - DNA, 221 bp, Homo sapiens
gattccatatgatcctgttgacttctagctatgtccatgatgagggcaaaattcttaatctactcaaagatctatagtcctgacccaagacatgacatagcacattgtgtgaagcattgaaaccatttaggttttctgtaatctgctgagttgtattgaactcctgaaatgctggagttggaaaaaccctaaaaatagcaaactgtttcacaaaattatgc

SEQ ID NO: 2280 - DNA, 42 bp, Homo sapiens
aataaggcatttttccagtgttctgccaagatgtatatacgg

SEQ ID NO: 2281 - DNA, 60 bp, Homo sapiens
gtttatactaccatcctggccttagttggctgaccagtattcaaatctagaaaatcacag

SEQ ID NO: 2282 - DNA, 508 bp, Homo sapiens
gtctttcctttccacacaaaatgtgtctgacagcaccttctcagagggcttgcacattacctcattgactggggaaatacagaggagctccgaaactacactctgaagtgtgtgccagatttgggttggaaggattaacttcccctgcttttgcccagttgttaagtgtcttgctgtgtttttcagttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaa

SEQ ID NO: 2283 - DNA, 1014 bp, Homo sapiens
tttaaaagactgtttactgcagttgctcaggaactgcttttgattcacattaagctgctttcagaaattaaaaaaacactttttaaagggtgcattgataaaatctgaggttttttggttgtcgtttttttctgtgtacatttttttcctaagtttatggcacagggtagaccttaagtattcctcctccatccttcattcttcaccctccattggatcctcaagttttaatgaattccaattataccttacatcagcaagttaaaaaaagtactttaaaataaagcaaagggagactgttgctcaaccatcaggaaacagttgtcagaagacatcattggttctgtgtttcctacggaaataagaaacgataaatattgcactgaatgtttgtggtttggagtccctgaataataaagagggaatatatttgcagaaagtcgcatagggttttttaatgcagaattttgtcagaagacaatggcgctgcatgtttttctttgagtgcaaatgtacattgctaagatttttttaagatggcatgtgctttgaaaagaagatattgcatttttaagagtttaaaaatcttatgagtgagaaatattaaaaaaatcttattttcacctctttagaagaaataaaagatgtttctcctatctccttttctctagtatttgactgttactgtccttggcgaatcgataatcattgcatagtgactgaaaagcctaagtgcaaaaaaaaaaaaaaaagatgttcttgtttctgaacttcgtgccatattttgttcctgatgggatcaacttaatgtttaagactttagatgtcttgtattaaaaattacacaaaaaaagtaaaactttttatacttacccttttaactctaacacatctctggtttctcattatgtgtgaatttccttgggtgggctgcctgagaactgttcattttattttaggccatgttacaaactggttatccttcatataatgactgctaaggtcagaatctaa

SEQ ID NO: 2284 - DNA, 279 bp, Homo sapiens
tttatgaagaccttgaactggtaaagggaaagaagccacatcattttctgccttcagtcttcccatttctctttcagatcagtatatgtactggtataatcccttaaaatttacactttcacaaagtactttcaaatgtgttactgctacagtggggcaaatagaaaaatgattgaaataaaaaaaagtggctattgggcaaggcagacataagaaatagaatgttctgttgagtgctgtgttgaaaattaagttgtaagctgggcatggtgagtcata

SEQ ID NO: 2285 - DNA, 487 bp, Homo sapiens
caggaaagatgtgttagattggagagttggaagtgacaagtaaggctcagaaaaccatgttaattcaggttgtgaatggccttgtatgctaaagtaaaatactcagaccttacctactaggcatgggagacttgagagaaagttttaagcaagttgcttttatgggggggttttctggtggtggggggttaggcaggggttaaataacttggcaattaggacagatttagaagactttctgaacaaaccacacaggaaagcgtctacattaaaatgaagtcctggtaaataggaagggcctgagtaacagcatttctacagtgtatgtgactaactcacagggagtgaaggaatcaagggtgattcacagagatagctgtgaatttcatgtctagcttgcacttgaaatatttgagccttggatacctttagcaatgaacttcagcagctgtataggccttttatggcccttcaccttcttgcggaa

SEQ ID NO: 2286 - DNA, 255 bp, Homo sapiens
tctctagtctggagaagggatgagatgtctgtgaagttgcaagttgttattccgcagcccaggcttccattgcctagtttttcctttgactcctttgtcattcctgcctgactctattctgtgctttacttgtggcaaatcgcatcatgggattagtctgcctagtaggccctgagggctataaaatgtaataatgtaacaacagcatgtcctgccttaggagaatgagtcttttctggaaagaaagtcagtagt

SEQ ID NO: 2287 - DNA, 531 bp, Homo sapiens
gtcagtagtgttagtctgctttagacatactacaaagtgggtgaggtaccttgtaaaatccacttcaggatggaaaacaaaagaatgttttaacatctgtaactagaaaggtaaccccactcatcgagtctgaagagtttaatccagaaagtgatttcctgttgcatataccatctttctagagctgacagtgtctggaatggaaagctgtgtgtttcaaacttaggtttgctgtctccagtgtcaagacttgcatgggattccttaggattacctctgccctttcccaatttagctccctcaagactcagctgttctcccagttcttgaggccaggggagtcttagttattttcagctattaaaatgtccagaactggagtattgcctggaacctggttcaggagtgaccagcctgagttagtagtccatctccttgtttgggtgtatattaaagtcacagaagagactggaaatcttgtcatctcgtggccactactgactttctttccatcctgggtggagttacata

SEQ ID NO: 2288 - DNA, 244 bp, Homo sapiens
caatacatatagtgaaaacataattcgtggggtttttttttccctgagttttgaatagtgctgaagtatataaaatagaaagtgtctctgtacccttacttccaagtctttcctgaggtgatggtcagtgcatcttcttctggacatttgtctatgcccttaaattcttttctaacctgcaacctgagatttttctaacaaagagatacctgtgcacctgaacatgccctttaagataatcctt

SEQ ID NO: 2289 - DNA, 128 bp, Homo sapiens
gataatccttaacaaaggggctcatatccttagagaagaatccattagtgatcctatttctgccaaattcttgtaaattttggtcctacccatttgtatctgtttctgacacatggttattcttttcc

SEQ ID NO: 2290 - DNA, 222 bp, Homo sapiens
tgctgggattacaggcatgagccatcatgcccggccacctggttattcttgagaacaggttatatacctgtgctgaatacacatcttcaagacttcacatatatcaaccatatccttactgcccttgaacatttagacctacagaataaggaatggagagtaagtcaagtgttctgacagccccttcacaggatttatccacatccctgcagcagtggacac

SEQ ID NO: 2291 - DNA, 346 bp, Homo sapiens
agcatttaactgataggttgttgtgaggatagctgagatgtctataagccacttagagcagagtccagcacaccacaagtgctatgcaagtgtttgctgtaatgaatgttgataaggcttcccctgagtcacgcagtgaaagactgcagcaccttcttgtttttattgtttaaccttagaaacctaaatggaggaaaattccctcaaagaaaagtaaaagtgctttcttctgtgccttcattttccccacaaaacctgtacgtatttgattttcttagatcatctttactagattgattagtagacacttttttgtggtgacctgcattctccaaattttgagctc

SEQ ID NO: 2292 - DNA, 247 bp, Homo sapiens
taaaattttttctttaaatagaagttgggatcaaacttgagttaaaagaaaaagccatttagagtatgctgagttagcaggagagcaaccttaaaacttgattcaataggtgcgaagggtttatcttcaaaacaaagtcactaacaggtttcagttagcatgtcctaaatatggtggtttggcattgtaacagttacatatcacaattataacttagataagaaggaatttccttaaaaaatacaac

SEQ ID NO: 2293 - DNA, 322 bp, Homo sapiens
gcccaggccccttggcaccagcccctccgcacctcacacctgctctgggacacgatcagaaaacacattatcccactccaggcgcccaggtattggagtgcaaagctgccctccatctcaggttccaggaacctcctcctcctccactgacccttcttgccctgacatctatttagggccctttgtttttctcactgggagatttaaagaatgggctatagggtcccagaacacagtgtatctccgtatccagttgaggtaaagggagcaaagtcaggggattgtatgtaagttctctattttctatgcagtacattttgta

SEQ ID NO: 2294 - DNA, 583 bp, Homo sapiens
cgcccatcgccaaatgccatctgacctcatttccttctactccttcttttctatgcacatttagatacttgtgatcgtgttatacacctacgttttttggaacttgtagcaaaagcatgtttttgagccagtatgtggaagctgtgagccccgtgtgggctggggaagagaagagggagaaacagatgtggcctagccagcctctagccaggctccctcagatcccagcctccagagccgccatgggtaccacgcgtctccaaaggccccaggcctccaggactgctgcccctccagcagattcctcgcacatttagctcaaagatttggtgcccatatccagctagcagaatgacaggaactggcttttccttctttttaggctttctagagtggcaaggttaagggagggtgtaggagtaggggaaagtggccggggctagagaccaggtgtgaaggatcagaacaagggagtggcgcccgtgtagcatgtattgctatgccacagtcctgatgggtccacatgttttagctttctcattttctgctttgagacaggaggacaggaagaaatgacaaggca

SEQ ID NO: 2295 - DNA, 147 bp, Homo sapiens
aaaaaaaagaaatgacaagggagaaggacatcaggtaataaggaagaacacagaagggagcagcagctctggggactctacctgccccacataactcatccatggacttctctcctctgaactcatgaatgaaggaaagacagccta

SEQ ID NO: 2296 - DNA, 384 bp, Homo sapiens
actctaaagcttttgatccatgtatagttgtatcctgtttctttgggacctctgttccctgcccctgattcccttctcttggccatactctgtcctttcggtgcctatagaacccaaaacccagctcggaggagatctccatgattgcagagcagttgtccatggagaaggaggtggtgagggtctggttctgcaaccgacgccaaaaggagaagcgaatcaactgccctgtggccacacccatcaaaccacctgtctacaactcccggctggtgagtggccaggaaccaagctgtctgccaagcactggagggacatgatgcttggaggggaaggtggtggctgcagggaagaggggagcatccagtaaataaataagcaaag

SEQ ID NO: 2297 - DNA, 117 bp, Homo sapiens
ttgacacaggctgctatgtggggaataatctgtgtggaagcaggagaccagctaggagaatgacaatggtcaggctgtgtgatggaggcttggcccagggtggtagccatggaggtg

SEQ ID NO: 2298 - DNA, 233 bp, Homo sapiens
aagttctagggagacaatgaagtttagggggcaggaaataccttctccatgcagggagaaatggtatctggagggtgggtgtgggaaggttcttctctggggatggtgatggttgaaggttaagggagttggggagaatgatgttgcccttcagtctttcagcactgtaagatgggtgaaatgcagccttctcagggtgggacacagctgtttcccaaaaactacaccattgt

SEQ ID NO: 2299 - DNA, 200 bp, Homo sapiens
gaaactgagaaggagggaccagaaaagacaagaaactacaaccacgtagatgtgcggagtgttgggcaggaatgagccccataggagtgccatgggaaccaagaggaaagacacccaaatcagaatgggtcccaggagggtgaatatctaatttgtttggagaacagattagtaattagcaagagtagtgtacaaggcag

SEQ ID NO: 2300 - DNA, 99 bp, Homo sapiens
tgagtgtgggatcataatgggccatggatgctgaagtaccctaaactctctaagggatcattgaacatgttaagttggaggcaacatgatattcattca

SEQ ID NO: 2301 - DNA, 232 bp, Homo sapiens
gaggaggctggaatggtaggcaggggctggattatgttgggaatcataggccttgttaagaaacttgggtcatgtcataggaactttggaatctttaaagattgggctttgtttagagcagatgggaagtagtagattctccctttggttcagtgccaacccaggacatcaacatggtgagaaatggagggggcctagaggagccatgcaggggccccattccccatcagct

SEQ ID NO: 2302 - DNA, 262 bp, Homo sapiens
ttttctgatcctatctttgggtctcattgagacagtcccttgggactaggacatagtttcttctgcttctggaataaaatgattagcaggtagaaaggcaaaatggtgcagatcagtgtgggcagaatgctacaatatatctagaaaataaaaaaggggaaccacgtatatgtctgttcgcatatgcctagcctgtctccagaaggaaacaagctggccgcactgaccaaatacattatcacttatttaaaaacaacaacaa

SEQ ID NO: 2303 - DNA, 408 bp, Homo sapiens
catgtcttgggtgtgacagcagggagggaggagaagaggtagggagattattgataacatctcttaccactctgccacccctcccaacctgtgcccgtctccacccttcacaggcccccagcctactgaggaggctcattgtataaggaaaagtaaatgaaaacaggaaaaccatttctgattaatgacgaaataagtacatgctgcatcctgttagggtgggatcttccaaactggggagagcagaactacctttcaatagcctttgcgaacacctggtcagagcttcccctgttagcatgagaagaataaggggcagtgaaaatacacagattttagctcaaaagaagagtcgaataacatctagaaatatacagcagttgacagctgcttcttccagaaagggag

SEQ ID NO: 2304 - DNA, 384 bp, Homo sapiens
ggtggagctgtcttactcccagacctgttgggctccaaagtctattctttctattacatcttgttctacattgttctaggatagtaacagtgagggggaggttcctgaattgcatgggagggtaaacaaagttatcccaggtccctttctaatctcagagctgatgatgctatgaggtctccagggcaaaataaaaagcttcagagaccaaagttcagtgcctccagtcacctctggagagtccatgctccattcatccatcacagtgggaaagcctgcgagaggctgctaggctgagcaaccctgctgtcctcagcaaaagcagggttcttttagggaaaaagcaatggagaccagaaaatgacaggcaaccagcagtatctg

SEQ ID NO: 2305 - DNA, 516 bp, Homo sapiens
gcagggcccaagaggcttgtcttgctcacctccagggctctcaggcaaggcagccttcggcttggcagtgtcaaagaaaccttatcaggcaatacacattgtcaggggctggagggccctggtgttgacaccagggaacttccggggcagactggacctggttctggatgccagtatgtggtccagaggccttcccatagaaaggaggatggcatgtaggctaggaaatcaccaaggaagccaagccctggtctctgtagagtctggggcctactgtctttggagagtgatctgaagttggagaagggagcagaaatggacatttacaagcttctgttgtttttcaggtatctccctcagggtctctgggccccctctctgtccctcctgtccacagtaccatgcctggaacaggtgagctttaaaatgagatttctgaagaacaccagaattcttttaaaaaatgggatattagaactgaaaggtatctacctaagtcaggcttccctaaatgca

SEQ ID NO: 2306 - DNA, 161 bp, Homo sapiens
agcgaattgttttgttttgttttgctttaactgcagcacttctaagcacttaggtgcataaaattccaaaatgaactgtgtggaaggcccaggggaggcaaggcttcccaaagtaatactctagtcctcaaaaagcacctaattatttcaacgcactagac

SEQ ID NO: 2307 - DNA, 119 bp, Homo sapiens
caggcgtgagccaccgcactcagccccttccacttttcaaagtgtcttagggtcttagtttggatggtaaaatatatgtcaccctatccatagaacacagtttgggaaacacaaacaca

SEQ ID NO: 2308 - DNA, 461 bp, Homo sapiens
agtttctagaaaaccaagcaccttttctttgtggagactggagaactagagcagctggcaatctttcatcgtgccctcaagttctctttctcccctatgcacttgcctttctttcctcctctcttccttcttgttctttttctcctaccgcctcttggtctggggctgcatgtgcccagcctagggtgtgtcctagagtaggatgattttggcatctgtccttggatttggcaagtcttagacttgcagaaccagccacaccactctccagggcctgggctgcagagagcatttgtgacgacagcccctctgggtgtgggcagaagttgatgctaatgaggcaggaggtagtcaggtgggtgtggctagggagagggtgaggtccctttggggatacaccaggaaatttgtgtctgaggggctatgtcccgatgtcccgggatccagcagcattatttccc

SEQ ID NO: 2309 - DNA, 960 bp, Homo sapiens
tggttgattctatattctttcaattcattggctaggattgtgagttttaaaggactcaggtctggttttttcctcaacgcctgtgtgctctgttcgaaggggtccatcatgggaatggagagatgctttctaaagatgtttaattttgtttcttcatctcctgtgctaatgagttccactgtcctcacatccgggcgggcacacaacgacttgtaggacaggctggaagagacagtgctcatgataaatttgcaatgaggggagagtgagtgtggcagccaggaaaaatctttcacctgatggagagaatcaaagacatttgaaaacattaaagactttaaaattactttgttgatggtttttcaacttagagtaggtacaatatggggagtaagtagagaataagggttggattgaaggttattaatagtaacttgaattgtaggcattatggtgctaagaaaatatcaggtcacactcaatagaaccgtatttgactcatgtgtcagttatgaatttgattgtgcaaatgcaaactctaaaaagaggaggttcctaggagcaagtaatttaataaaatcacgtaattctgaagaatgacctacaggaataaccagaggaaactggagagtgcaattggaaccattcagttgaaaaagaggatgttattttatgctgagaagttgtcactttgtgcagcaatactatcatgagttaaatcattttattttggaacaaaataaatacttaataagatcaatcttttctcaattcctttaatagcctttcccacaatacctctttgcctaataacaccaaccatcacatactcactctgagccaggcactgtgttgaatgtgtctgtaggtactaactgtattaattatggtttttaatttctgcatcttaggatgatttaacattcctcaggaccttacagacccagcccttcccaaggc

SEQ ID NO: 2310 - DNA, 38 bp, Homo sapiens
tgaactcattctatcctcatgacaacactctagaaagg

SEQ ID NO: 2311 - DNA, 117 bp, Homo sapiens
cttcaggtaactgtctggccatccttcctccttctaaagagctctgcctcaggccattcttctagaaagccatcccttcatgagaggctgtcacaatactacataccaatctgtagc

SEQ ID NO: 2312 - DNA, 251 bp, Homo sapiens
tgagaaacagatcttattcacataactgattgattacatagagttttaagttttaaagaagctgcttcccaaagtaataactagtgccaagtattagtagaggttccactgatccaatattatttcaaacaggagaaaaactgaagatgacaactcatgaatgtgattttgtatgtgtaaaaccagtgaagatgaggtaggccaaactataaaacacaaaaaacagtaagactgatcaaagtataaaatag

SEQ ID NO: 2313 - DNA, 36 bp, Homo sapiens
attatagaagtatttgttcaataaaatatagagcag

SEQ ID NO: 2314 - DNA, 122 bp, Homo sapiens
ttaattaattaaaatataaagcagtaactaaaagcagtgttggctaaaaccagagatgtgtgatacaatggaaaggtgttatatataatacatcctaaataatgaagtttttattcttttta

SEQ ID NO: 2315 - DNA, 1031 bp, Homo sapiens
gttgtgataaaataggggttattttaaaaagacattaccttctgacctgaaatcccataaatgccaatcagttcttcaattccatctagtacaagtatgcatggctttaaactgatggaagcaatgaatacttccacaagaaatgagaagaccaagccatctgagtcttcgttgagaatatctgtttcaagctgagtacctacagcatagaaatttgttcaaattaggtagaaatgattccgtcattgctaaaacatgtttatgggctggggaagcagaagaggttgggaaaaatgagtgctactcacagctgtacgtctaacacacatatgtatacatgtgattaccatcttcaaaatattcagcccagaagagataatagcgatgtttaccaccagattgtctccaatacattttcaggatttgatataaaaaaatttttgtgtgatccaaaacattactctcatcttccagaatgcaaaaacaggtcatgttacaaagagttggatacgaagagaagccctgtgatctgtgaagtttctgacactccttaacattgggtgcgtgcttagggtcacagccaccaccctgggctcttccagtaatgctcaaatatagaagctcccacccactgtctcgtttccttggccctagcccatcttcaacttaacagaaataatcctaaactctagccacactattgggccctagactttggattctggaaagtatacattcttagaaagaactaagctatgaacccccaaaaggcaaaggaagtcattagagatgattgactttcagactgtgataaagtgacctagcagcaaccccaagttgtcatcaactacctaataccctaagaacattttactgcaaattccgtcttgcttttatttttcacaagcaatattttccacagaaatttaagcacattgaggtctggaaaatacagtcacatgtagaacctttaatggattaggtctctcagatgcattaagattttgttagagtcgttgagagtaattatg

SEQ ID NO: 2316 - DNA, 327 bp, Homo sapiens
aggagataaaatgattcatatatgaagtcaaccacctaaaggaagtggaaattggttctgtatacaaatagccaaatttcaaggcagaatatgagtctggaggctgctgaagcttgatgtagaaccatcacaataaagaaccatcacaataaagaaaagctctgtgtgaaagacacttcaaataagcctttaagggtacataggcagagacgaggagaagggcatatcatcaagacagcacagccaaaggctgggacataggaaggtaccatgaacagttgaaaaacaggacattgcttagagcagtagttcttaacaggagaggtt

SEQ ID NO: 2317 - DNA, 240 bp, Homo sapiens
aaagagatttttataacacaaagcgatcataaaatcgattacttgaaactttttttatgaatgtgggacattaagaaagtgaaggtgtcagaaaagatagagattgagcttatgtcaaacaatgaaaaatgattttcaagaaagggaagagaaagaaattcagctgatgattcatcccttgagtttttatttaaaaacctttaaaattatgggcatcgttgagatttcagaactgaaacg

SEQ ID NO: 2318 - DNA, 93 bp, Homo sapiens
atgtgaacacacagatcatcaggagcttttaaaatactattttttctaatgatttgttttcaagccatgtgtggcccccatttcttttttttt

SEQ ID NO: 2319 - DNA, 509 bp, Homo sapiens
cgtgagccaccgcgcccggccccccatttcttagtgtagatggctcacaagcagcccctgtcagagcccacagaggtgtggatcctctgcctcttccacacggttggcatagagtgtaaatgacaaggtgaatgtgaatgaacctcaggaagtatatactgcctgacagtcacagagcatagagcactaatataatcagcaaaaattaattctaagcaaaaaaaaaaatactcatggctgatgcttatagatatatatctttatatatgaaggaaaatatatatgttgagtggttttaaaatcacatttttggtgactataattattttttctgaaaataatgttgacaataaagtcagtgttactagtattggaaaatgattctaaacatttctccttattttggcaagaacaatctgtctctactaaatgacaatggccaattacctcatttaaatggtaatagctcacgtgtttaaacagccactttttagcagtgttatctctca

SEQ ID NO: 2320 - DNA, 141 bp, Homo sapiens
cagggtgaaaagcttggcaagctctgccaaggatttctgtccattccacatcaccaacttgagcagagactttcccgatgctaggagaggagactgataaaaagcatccacaggagggaaattttcctttgctggctcaag

SEQ ID NO: 2321 - DNA, 120 bp, Homo sapiens
ggatggcagtgtagtgatgaggactaggggcttagatcccaacagagacctgagtttgcactccctgctatgcccttgcttagctgtgtggctctgacattctgagccccattcttccta

SEQ ID NO: 2322 - DNA, 69 bp, Homo sapiens
caaacctgcccccagattccatgtggtcacatggtaaggaaacatgcaaatatgaaaatcagtgaccat

SEQ ID NO: 2323 - DNA, 583 bp, Homo sapiens
gtcagtgactactctgaccttccgtgaagcatgtcttctgtgacaccagttgcctgcaaggcaggcaaagggtgtgggagtcggtagagctggctacaggcaggtcccatctacaagatccctttatcctgacaagcagggattgaggaccgaagagtagaaacatgagtgtcactgggtgtgattaggtgccccagatagaaagggtccctggctcacagcccacgcaggatctgcagcttcagacagctgaggtggggtgcagaaaaatgctctctgcaaagaggctgaatctgctctgagcacctggcctctcaggctggctgtgttcacagcagcagctcttcctcctctgcccacatccacctcacccaggtgaaaccaggtctcagcaaaggcagccacaataaatgactctggggccagccttctccgctcacctgcaggctttctgggctgcagagatgacagctgcaaactcttgtttttgcagtccttcctctccctactcagctaatgaacaagaatgtcttgtttcccctagcagcccctacaccctgcttctttctctagctcagaaagg

SEQ ID NO: 2324 - DNA, 90 bp, Homo sapiens
cgcagctgcgtgccatgtactactttaaattccttacttgtattttgtattatgttttttgggtttttttaacgcagcttttttaaattt

SEQ ID NO: 2325 - DNA, 498 bp, Homo sapiens
gtgggccaagtccaggaccagcccttcctcttgttaatgaggaggggtgttctctcagggttagaaagtgtcaagtattcgtaggctgttcctgaacttattctactgttgtcagcttaaaaatctggttttttttgaaagacagcagctgtttttattaggagttctttgcatccaaacacacgttcattaaaataacaattcactttgggaataaaatcgtaattgagtgtgtagcacggagtttacatcatcagcctggccagactgaacacctttgggatgtgccagaataggattagttgctgtgtagacacagtcacacctgcttctactgattttgactttatccattttatatgccctgagaaatgcaaccataaagacctcatccacacgtgttcttccctctgtttactcacagacacccaccacatgcacagaaagaagctcaaatccctgtacccttttatagagataagatgcacccatcaaaat

SEQ ID NO: 2326 - DNA, 1366 bp, Homo sapiens
cccctcactgtgtttctcgcacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccactgtgaacagagagacccacagtgagccctgggctcagaggcacctcccatatctccatgtctgcagccttgagacactcacatctgggagctgccaccagcaggaggaagaaccacaggtgtttcatgttcttgcacaggaggtccaggactctcagaaagtatttcccatgtgagcaggaccctgaatttaaggaaatgtgtgatggtttcccttgggtgcctaagtgagatttgcatgtgggtggtgcctctgtatggagaggtgaaaagggatgagggaggccccagtcttttaggctctccctggaaggaggatgctggttgtgccctctgagaattcagttatcttcctggggcctcaactcactatgtcctggctcctcttttcccaggtgaggaaacagattgcaacagcagcttaatgtaacaatcatgtgagttcagacacaccaggattcacttaacgttatttgtagttcagaacctctatcaggtttagagggaatcgctctgtgccagggagtgggtcttaaatagcaaaacggcctcagaaaacccaacataatctacagcgagacctcagcatggcaagcaaggaatccctaaagccaccagggagctccggatgcactgatacggcccagacacatggcgagtccaggaactgatggggactttgggggagcctcttttattattttttaggattctgtggttgaaggtcacaacactgggcctgactgcttcctgaaccaagcccagcacaatatggttcaccccagtgacattttcagatgtttcttcctgtaatgaaagcgcggtgtgatgtgtatgcacctatgtgtttacctaatgaatgtaaagagaagcacatttcatgcagctgtattttcataaatgtcagtcattcatcatgttagtgtctatttttccataaatctgtacagaacaaattattcattcattgatttgtaatagtcttattgagacattattactatacattaaatattgcaaaaagtgtgcggtttaataagtactcaa

SEQ ID NO: 2327 - DNA, 162 bp, Homo sapiens
atgttattccactcgtgctcacctgtgcatccccaaaagccatccaaataatgaataaacaaattacacttaaaagtttccttgtgttcctctacaattcctccttcccaattattttcttcctccaccatattctgagtcagtccttcacatttaatacct

SEQ ID NO: 2328 - DNA, 890 bp, Homo sapiens
agtatgtgttttatttgtgtggcttctcgcacataactacttatgatgcacacatgttgagcatcaacaatgtattgattctaatgatggatgttattaccataaattagcatgccattactgtttatctatgtatcttcttggtatttgtaccatttctagttgcttagtattacacagaggtgcttctcagcttggagatgtaagcaccccataaaaatatgttactattcttataacaaatactaaacttactgatctgcaaattagcatatatacatcaaatttttgatgttataggacaaacaatatatctgaaatctgaacagacataaagacttgcagggaaataaacaggagcagatgataatcttttctgggacagaggctgccaaatgtcatttaagttagcacacgattaaagtagacatattcattgggtggtttcaatttgagtgtgatagagaagttattgtttaaattctcagagtgtatgcagttgaggaattcctcctgctattgaagcctttttcttcagtactggggatacatcacaaaatgctccagcctctaccccttgggatggtgctgtctgggaaagcaaaacagcaactacagctgaaatgcatccagacacacctccccatcaccactacattgcaagagaaattatctgcagaggtaaagccatcaaaaccactgttctacagacactggagaaaccaataagaactgggaggggagagaggaatgcaccaagtccctgtccaggcccacctcccatcttccctcaggagtaacagccttattcaaaaggaaaaggcagaaactgaagaaatcagtgggaagacatagtggctgctgaaggaatatatgaataaaaacgaaga

SEQ ID NO: 2329 - DNA, 84 bp, Homo sapiens
ctaaaaaaaaaaaaaaaaagaatgtaaagaaccggccaagtgtagatgaagggccctggaaacctagctacttgctagtcagga

SEQ ID NO: 2330 - DNA, 313 bp, Homo sapiens
atctcttggcattggcatggtgtcggctacaatggatgctgggagcttggtgtcacggctccttccaaaggacatgcctgctccctgagttaactcccagacgcagttggacaggcctcctggggtctgagaagctcctttcatgtactgaaatcctgtcattatgtttttgtattctagtgtctccctaaaagtacagtgagacccagggtccattcatgtgtgtattcaggactctctgatttttatgtattttattcatctctctctactaccttttctaccaaactagacatttaaaaaattgcaatat

SEQ ID NO: 2331 - DNA, 1065 bp, Homo sapiens
cttagcttagagaagtgacaagctgagaaaacatggttcttatttttacataacatgaatagcaggcaaagcagaaaagctgcacactaatcaatttgcttcaatacatcacataattaaagttgggaagctctgtgtgtgtgtcagttcacgtgtttttgtgtgacagaagagagaaggcaggaggagagaccatgccaaaaggagaccctacctgttttgaccataatgtgtgaggtactcaagtaaatacagggacttagtgcttgatggacaaggtcctcctcagatggagaagacaactggatgcacctccatatgggtacatattagtatttacataaatgccattttctaatcatatcaacactccgacacattataagagatgtattggagggtgtctggtggtgaaatattatggtgagaacaacccacatctacagccccttttctgccctgttgcacttgccctgatgcgaacttgatcctgctcatcctgacccctaacaatcatcctaagcccccatactgccccgaatgccccctgctgctcctattcacccctgcagggagggttgtgtctaggctcacaatgaaggcccttcattgcgtcttttgcttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacagtgaaattcccaaaaccacacatttttatgagaataaagagctcactttgtccaatttgtgagtctcctagaacaattcagtagatttcgaggttaggttaaaaagtattatcacatgttcctttcctcaaacttgcaaccaaat

SEQ ID NO: 2332 - DNA, 150 bp, Homo sapiens
atcatctggtccggtggtcctaacactttttcatgaaaatgatcttgtttccaaagaaaagagatataagtaatcccaacacataaaacaaattttttaaaaccactaatgtgttttgttagcataaattaatttcttttttgagacaat

SEQ ID NO: 2333 - DNA, 529 bp, Homo sapiens
agtataaattaatttctaattaaaacattaacatctaactcttatacaggcatttagtgaacatgtggctattttgtccattagaaaatttagcacaagtaatatggaaaatgatttggatgccttagcgtttactttatttctgaattgtgtttcaatttacaacctttgaagagttcttaattaacataggcaggaaattacagacagtctctttggttgaataaaaatgggagcagtttgttccaaaggctgcataaaaatgagttaatgcagagatgtctggtgtgttacacgtaggcgtatactgtggttgagtatatatgatgtttatcacagttcttcacattttgaaaatatatcttaaagattatgaaaatactgaagtagagccttggaatagcttgaaagccactgacctgtctcatttagcagacatgatttataggttaaattagccccagtgactgtccaaggtctcaacagaaaacagtaggactcaggctaacaccagggtctaactgattgt

SEQ ID NO: 2334 - DNA, 411 bp, Homo sapiens
tatgtttagtgggaatacttgccaataagcctgattttctatgataagcctcttcttccttcaattggttaggccattttgttcttctctatactacaaatctgttacgaaatgaaatttcagagctatattttctgaaaaggataaatgtcctttgctccaaattcattttatttttattcctatccacttcagtttgtataaaatacagaattctaatcttcaccagcaagaatttgtggtttttcctaatacaaactggtaactgtaagctccagatttacaaaaaaaaattcaaatttgactttcacggccagctaggtcaatactctatgccacctttgtattctgttcctctgacattttagcttttattttttaaaaactggttcaatatgttgctgactttga

SEQ ID NO: 2335 - DNA, 305 bp, Homo sapiens
atgccttggttagttcatggaatccttaggcggcaataacggttcaaaatgaacattatactgcagctcctagtaagttatggatttatagcctgcccctgctcaagagctccagaagttccttcagcttaaaggtaataggctgtttttctatcattatttaaaaacacaagtcgaacagtgatttccttgcagccctcaatcatatacagaatacagtctcaaagctggtacctcagggctcaaaatggggagccccagggtcactagggtgactcaaacccagaggaaagatggtcttgggg

SEQ ID NO: 2336 - DNA, 595 bp, Homo sapiens
tgaggaaatcctggcttgtcatcgaaatcataccatggttttagattccctttctgataatcgaagaacattctggaggcctgaggcagagtgagccaccagaagaaataggagctgtccaaaataatttaaagtcccaggcccttgggtttgctttggggaaaaaagcttttatcacagccttttggtgcaacagaaaacaaaatgtttgggagaggttttagtaccagcacttcaggcagtgcatgtaggcaatggataagagagaactcaaagcttctgggaaattggaggtgtcccatgtttataaaggggaaattcaagatgcaattaagacgactcctttccaagaaataccaggacaaagcaagtactccaaagccacccagtgccactttccctcatccctccacctgtccaacacgtgcacctttcagtgggtgctctgcacttgctggcatctgctattcactaccatattccctgtttcaatcactccattaatctccttgcctttgtggcttccaccttaaaactctgcttttgagtttttgaactagatagatacgagcacagatcctagcacttggctgtg

SEQ ID NO: 2337 - DNA, 1929 bp, Homo sapiens
atacattcatcctatcagataagcaacaaataccagtttcttttctttatattgcttttcttggtgctcaggagcacctctgcacacctctctgaatagagggagcacacttttcttatggaacctaaagtcaccagagtccataagttgtcaaaatggaatccttgattctttttgactttggctctttctctcttttaaccagagtttgttctctgctggagaaatgcttttcattttacttccatatttgctgccgtttcacatttttaaaagtatattcaggccattctctagctaaataacattccaatcagctactgtttaagctgggaattgatatcatttatttgtgtttctttgaatttgccctctatgttatctttaacttgactttaaataaaacataatatgcattgagttccttccatgtgtcagatgctttttacaaacataaactggcttcatcatcataaaaccaacccagtaaattaggagatataattaataaatagtgtcactaattattacgtattttcactttatgacagcaaagtatttttgctgtcaaagcataaggacactggatcattgtcaaaatccctaccttcactcagttgtccacacctgggttaaggcttattcttgagcggctgcagccctgggcactcccttccacctggaatcagagaatcacatataggcataatgcctaggaggaagtaatcagctcgtttaagtgatggctgacatcaggaggccttttgagccagaagaatgacatgatgatagctgtgtctttggaagataaatgtcacaaccacgtgcagtatagattacctgaaaccacaacatttagcctttatgcttacacatctggggggcatgatttaaaagctcataaatacaatctggattttaaagaagggactggtgaaaattaagaatttcaaggttctaccaaagaaggtgaaggatcggtgtttttccaactggtttatgtgtcctaaatatttatgtatacaagtgcatattgttagtgcagtctcttggaagccatgtgtgggcagcagatctgctattgccctacctttcagtttaaagttgcaagagaacggaaattctctgccagcatgagaatcattcatctggcagccacctgaattactgttaagcaacacattgagtttgacagataaccctgttcttagccatccttcaagaaaagcatgaaggagccttcatgtttaaacatttcagccaaatttcttccttctgacaatgcatggaacacaatgtctttatttcctaatgaaatattcatattggatgtatctatggttagaagagagaataataaggaattatctttatttaatttcttagtcattctggtctcagagagcaagctctcgggttgggtaatgacgtcgcccaaggaacctgatgtttttcattgagttataaatatctctcaacttggcaaaccaatagttcccattcccaggatgacaaatgagaaaaatcgttactatttcagtggatagttttggatctaggaatttgttgtgagaggaagggtggtgttatagatgtcccttcatggggggtaaatcagcacaatatgggacttcagaggacttcaatatgggattgcaagggaatcaagagacgctataggagatgctgaagcagtgtggccaggcctcgtgggaggggaggcctcggattgggagtaaagcctgtgtgtaagcatgttggggaaagcccgagagcagcctgagagatataagcgtataggtggcccttggtcagtcatctaccaggccctgttcttacaagaagggtttctgttgtcccaagagacaatacaactagcagaggaaaaagatcctagacttcggggccagaaggcacttatttcaaacc

SEQ ID NO: 2338 - DNA, 677 bp, Homo sapiens
gtaattcttacctcctggtgttgttgagagaattaggcaggataacatattaggtaaggtgccaagcacatggtgagtggtccagccgtaacagctgtcacatatatccatggggcttcctactgcctaaatccctaccagatgcttgaatgccctgattgcatctgttttccacctacaactcatctaagaccatgaccctacatgcccaacccataggctccatccagcagtctcccttgctctgtttctaaaatgaaaataatccctttccagttttttaggctttccatagctggtctccaagacaaaccgggaaagactaccaaaagaaagcattttctttaagttttttgttgttgttgttaatgagaaaagttacaaagataaaagaaatctctggaagccttgatcaccattgtcccagagcattattgaaatgcaaatagattgtgacagtttacctgttacagctctgtcttcaaacaccacttgagaatcatgtgaaaagaaaggggggttttggtggacagtgcaaatacacaagcctcccctgttggtagagaagtatatgtagcttgtgtgaaaaaggggatcccatggccagactgccaagggacgcgtctcgaggagaaggagaggcacaacattttaccagcccctacttcatgccagtt

SEQ ID NO: 2339 - DNA, 294 bp, Homo sapiens
tgcgggtgtaatgtgcattattaggaaggctcttaggtgaacattcatgtgtctagaagaaaagacgttttgaacatatggaacgtagaaaagaaatttttgttaaattctttaaatcccagcaagtgcacttcagattcaaagtccttaggagtccccccatcactcagagcttctctttggctcttctccaccatctcctagtttctcctctccctttcctctctgtccctttcctctctctccagcactggaagcaaaactaggcttttctatttagccagatctcagggc

SEQ ID NO: 2340 - DNA, 200 bp, Homo sapiens
agttctgtgatagttcatttgctcttcaaccatttcctggtgaaaacagccaataaggaagtcagaaaaggactgccagctgcaagaagtgacttctgacatccagaggagggacggcagagaccttctggtagttggaactacttaatatagagggtggcaatctctcacacctcagaatgtctctgagtcatctagag

SEQ ID NO: 2341 - DNA, 27 bp, Homo sapiens
ggccagagaaaataaactaaggcttat

SEQ ID NO: 2342 - DNA, 245 bp, Homo sapiens
cttactagtcttgatttttttaaaaactgagaattataaaatatactttagaaggattcctatccaaaaagctaaaataaaaatgcatagggttttagaggaaaattctgatgaaagaatgggagagagagaattattataactaaattcgatgaatgaattaatgagtatcaagatctatgctcagacccttgctgtaagatggctccatcaaaggcctgccccccagtggagtttctgcctca

SEQ ID NO: 2343 - DNA, 314 bp, Homo sapiens
atggcaggaccagaacaaggactcaaattttccagctcttggctggagccttcccataccccaccacccctagggctgcagcctctcacctgttgaagcgtgagctcagtgagttccagtttctttttcagctcctccaagtcacactgcatccctgccttgtcaatcagtacaacttgaagctgctctgccaaagctgagttctcctgcttcagctccttattgctgttgctacggccagaggcagtagagaaaggaatgaacaaagaacagaaagggctgctttggtgatcagccctctaccctcaccccac

SEQ ID NO: 2344 - DNA, 266 bp, Homo sapiens
cctgtgcacgcattcaaacctgtgtgaccacgtcaccatgctcacatgcagcccttccacctcccagcacatcacccacactaagggccccacacctcccatcccaccctcccccgtcctacctgttattgtataactccagcctgagggcatcgctgtctctggttaactggttgttgtactgaaaatacagaaaggtgaagtcaggatacagcaggcagagaagcagctggcagactaggaacgacagctacagtgactattcc

SEQ ID NO: 2345 - DNA, 53 bp, Homo sapiens
aaaaagagaatattactattgttattaccgttatgactgccattgttggaacc

SEQ ID NO: 2346 - DNA, 276 bp, Homo sapiens
gctgggggtgggggcacagatggaaagggggataatcttgtgttcagtttttgaagggtacattctcatagtccaaaactcagaaaatacagaagggaaatatctcccagccaccctggtcctttctcctgagttttttacaaatccttgcagacatgttttatgtatattatcatagtacacacacacacgtgttccctctctctgcacaaatgttaacatactaaagatactcttctgtaccttcacagtgcaagtaccatatctcccacctag

SEQ ID NO: 2347 - DNA, 1206 bp, Homo sapiens
ccccaactcacccacagcagccgacacagccccaggctgactctaacaagcacgcacaaaagcagcgagaaatggcccatgctgctttctgggcaggacactccatcccgcagaagggacctaaaggtccctcactcctccatctggaaagccgggctgccagggtatggggcaggcggttggactcaccctatctgccttcctctgctcctgctccaactctcccacatgctgccaggaatacagcagatggctggccagatcctcggcctcttctagaatgagagaggttgagatggggcccaaaggactccccctaaaggcctgtcaaagcaccaggttgaaggatgacgggtgcccagattcccacattcaaactgcctggcagcacgttcattgtgatacagtgttgtcttcaattctgctttctcaaacatcaagactctaattatctgaattgaacctttaggagaaaagccaagcaaatgctgaaagaggaggaaagcaacattctccagaggacaggagggaacttcacaccctccactcacctgtaattgcctctttagggctccccggttttgctggctttcttgcttttcctataggaagaggaagacagagctcttactagggggaggcagagatggcacagcaagggacatgcccctagaatgccaccaatgccccaggacaggcccacccatgggaccaggttatcagggaccctgtggggatgaggtggaatctggggagtgagcctttttccccaggctgggggtgggcaagacgagactggggcctctacatctgagtgccccccaaacccagcagtcatgccgtgagcaaacaaatcatttcttctagttgcttgacaagtttttggttgtgctgtttctgcggggagagtcaaaggaaggtgaccaaggatggccccctccactctattccccagaccaggaagcggtagacaggggccagaaatggattttaaaggcaaagttctcagacccactaggaccatgaactggtaaactctcctcaagctcccaaggacagaggatttgggtctttgttggttttggcccacggccacagaactgaaagtccgaatctggattctcccgaaaggacagtaacataaacctttagagatggagtctgagaaaagctcacccttctaccagcttgtgatttagaaaggtg

SEQ ID NO: 2348 - DNA, 2368 bp, Homo sapiens
aaccccaggacatgtgtggcaagggctggagcatgggtatctgaagaagagacagtaggcaaagagggcagcaacagaagagccatgatgcatgctccgtgctctggggtccctctagctgaggcctcggcccccctgctccccatttgcccttggcatcagggaccctcagccctttcttcagggccccaaggggaaactggagcccaggacttgcagcgtggaattggtggaccccattgaactcttaccaatgactcgatggttttattccgtcgactgattgttatataactcgagtccagggcgactgttacctcttggtatctgctctgaggcacgtgaagagaggaggagttggaggaggatcgaggggagaggtagagagagcaatcattagggttggggggagggtgtgagaggtctcagatggcagaggggcacccagcccccactgtgggaggaggttggagggctggcctgcagggtcactgggtcatggcccagggcctcttacttccagatccttcagggtagcggatgatccagagccctccgcacagatacctgttgctgactacaagagatgagagtgcgcatggaaatcttctgtcccctccatgtctaagccctctgacttcctttcttccccagcaactgacaacattttcttttctgcctaacttggacccttcatcccataacctctttgtgccaacttctctcatggtttttatctccccaccatcccttcctcccaagcagctctcatctggtgtttctacagtaggataaaatgatgtaaccagccacggggtacaactccttcatgtgaacagcctcaaggaagaagcctcagggaagaggcaacttcctcaacatggcccagcaaatcggccagtcccaggatctttcctctctctggtgattcctgcctcagtttctttctatcatactttcctttcccccgcactcccctcaatttctgaagttcctcagaaacaacgccattgagctgttgggagagttgttgcaggctctcggttaatgagaaggtcctaagggcagagacacaggcgtcaggggtgcaggtggctcaatgggaaagaaggtgttagacagtggcctccctgactccctcagcctagagactgctgccctgataagagacactcacttgctttcatccatgagattggggctagcatgatgattctgtgtgggaagaaacatatgagatggtcattcaatttctgtaagaatcaccgaggacaggtgagccaagttcccaagctcattccaacaatattctatctccccaaacctcaaggaaaagcccagtctcagccttcccccagcccagtccccaggaagggcacctggccctagggaacaaactacttgtgaaaagagaagagaatccatagtaggtacaggagggcagtgggcagaggaggaggaagcatgaacctgaggtgccgctatgctagcaagactggcaccagggcaagggacaccaccaggtaacacggtgtcattggcaggtggctagacagatgcagcattgtctttggcgtctgtcacagaacaaagcagggcattagggggccatgcaggagagaaggtgcctcagtggcatggacacaagagtgtggaacaggtatgacagatactcacgcaatgacagtgacagtcatgcatgcttggagccactcgggggtgtggatatggtttgcccaggccttgggctgctaggcagcattttgaatggccaaagctcaaagcaggggctgcacggcctccttcatgaatacatgaggacctcgctccccctggagttcagcaaaagacagcagcaggttctgacctgtggcagccacagcaggctggaggaaggtgtaccaaagtcagggaagagaaaggcactgttcttccagacggccagtctgtgccacagagtgaccctaactgggcccctcctgggcagaggacagtgatgaggaagtagtagtctgggcaatgtacaatgtagctgcctctctcttctctcttcccttctcccttgcagtggcataatcagcaggggctaccatctcctacagctcgcccagcttctcctgcagctcctccttgacatgctgctcagactaaagtgcattgttgatctccatattctcactgttctggacagagagaagcaatcacgccacccactgcagctggagaccgcagaacttggtgtctgcctcccatggcgccgggaaggatggaggcagattagaaaaatgatcccctctcccccatagccatcaaaccagggctctggctcacaggtcccttcagaagtgccacttcacatgagggctac

SEQ ID NO: 2349 - DNA, 789 bp, Homo sapiens
gggaggagggcagtctccccaggtgggatgcaccagttttacaaagctgctctctgtagctgctccttgagctcagggttctgggagagtgtggggctgatggtggtgaggtcattttgcacggtccccagggtttgcctgcatacctccgcctgctcccctcagagctcagccacccgccccagctccagcagcctctcctgctcccagttcaggcatttcaagtcctcattgtcttgcatgtgggcccactggagctgtcctgctagactttccagctcctcccacaggtgctcagcctctgcctgtagctgctgctgcagctgcagaccccagaacttggtgtctgcctcccacggcactgggaaggatggaggcagattagaaaaatcatcgcctctcatccacagccatcaaagcagggctctggctcacaggtcccctcagaagtgccgcttcacatgagggctgcgccccctgctgggggctccaggggtgggattcagctgagaaaggaagcagacaataacggcctctggattctcaaaaacaccctcctcttggtacacagctcctctcgggctccccagacttggcctccctgctaatgattctcaaaaaaaccctctgcattctcaaaaaaaaaaaaaccctcctcttgatccactgcacccctcaggctccccaaacttggcctccctgctaatgattccttgcaccctgatggtagccaatcttccaagccactttcagatagagacaactgtgggtggctgacaacacacactt

SEQ ID NO: 2350 - DNA, 1775 bp, Homo sapiens
gcctcctggcacagacctctttccctctgcctcaaagcctttccatgcatccacctctctggcattctaagccatccccacagccctctgatgccagtcctgctcccaggtcaccccagccccagcttacccatctggttccttagttcagccaagatcgtctccagctcctgtactcgactcatgctatgcaccgtctcctccctcaacgcgtgcacctgcccaaagcacagggggaaagggccctgcagagaggggctggcagctggacaagctaccatctccctctctgcccctacctccacaaagcccagacccatgaccacctctggctgtgctcctcccatttcacagatgcctggaacaatcaagtgacctatctacggtgggggctgaagggtcaggtctcacctgctctgacatctcccgcatcctctgccaccacaaggcgctctctcctttcagattctcagcgtgttgatctttctccatctgtagttgtttcagtgaccccattacctgcaagaatgggcacagaagttaggaagggctgtcactggtcctcacacgctcctggccacctggggtcatcttccttccacatccctccctctgcaaagcctcacctgccccaggtgtacttccagctgtgcccgctcctccatggcctgctgtaactgctggttagcatcaagggcttcataaccagcttcaactcctccatctgggaagctgggctgccaggggatgagggaggctgtaggactcacactgtccatgttcttctgctgcgtggagagagcaaagagagttcgttccaattctcccgtaaactgctgggaatactgcaggcagctggccagatctgtggactcttctgaaatgagagaggttgagatggggcccaaaggactacccctaaaatcctgtcaaagcagcaggttgaaggatgacgggtgcccagattcccaccttcaaactgcctggcagcagcacgttcagtgtgatacagtgctgtcttcatttctgctttctcaaacatcaagattccaattgtctgatttgaacttttgggagaaaagccgagcagatgctgaaagagaaggaaagcaacattctccagaggacaggagggaacttcacaccctccactcacctctaactgcctctttagggctctccctggttttgctggctttcttgcttttcctataggaagaggaagacacagctcttactgggggaggcagagatggcacagcaagggacatgcccccagaatgccaccaatgccccaggacaggcccacccatgggaccaggttatcagggaccctgtggggatgaggtggaacctggggggtgagccttcttcccaggctgggggtcagcaagacgagactagcacctctacatctgagtgccccccaaacccagcagtcatgctgtgagcaaagaaattacattactagtgtgattctagttgatccacaatttcctggttgtgctgtttccttgggagagtcaaaggaaggtgaccaagggtggccccctccactctattccccaggccatgaagcagtaggcaggggccaggagtggattttaaaggcaaagttatcagacccactaggaccatgaactggtaaactctcctcaagctcccaaggacagaggatttgggactttgttggttttggcccacagccacagaactgaaagtctgaatctggattctctcaaaaggacagtaacataaagctctatgaggcagga

SEQ ID NO: 2351 - DNA, 125 bp, Homo sapiens
gagtgagaagttcagatctggggatcctgggccattccacacagtgccctttaaaaggtctagagctgggctcaatgtacaacttggtcaataaagatctctactgtgaagttgctttgctttag

SEQ ID NO: 2352 - DNA, 127 bp, Homo sapiens
ctctgctatctattatcaccgtggaatagttgaagtgttggcttgaacctcagaaggaaataaacaggctcatgagctagccatataagtataatctatataataatggttttcatccatgatgcat

SEQ ID NO: 2353 - DNA, 321 bp, Homo sapiens
atggcaggaccagaacaaggacccaaattttccggctcttggctggagcctccccataacctgcatgatccctagaccatgtccccagctggatggggctcccaccacccctggggctgcagcctcttgccagaagcaggatcttagccctctccagcttcctttgcagttgcttcagattgagtcgaaatcttcggtcactaggacttgaagcttctcttctagttctgagttcttctgcttccggtcctcgttgttttggctatggccagaggcagtagagaaaagaatgaacaaagaacagaaaggactactgtggaa

SEQ ID NO: 2354 - DNA, 910 bp, Homo sapiens
ggggtgccctactagtgactttattaccctgttctcaaaatctgggaagtgcgggagtaacagagaaacttgaattttgtacctgactataattttctctaaaatatcagctctcattttccagttgcctgggacatttgcacacaaggttgcccatggccctgccacctgacccccaacccactacagtcatggaaacaaggctttgctgtctccaggtcaaaattagggcacgcggagcctcgagtttcattccagccggctccccagccctggcagaaccgcaaacgttctcatatttctgtggggaccaactcgaggcaaagacagccttgtcctggggctttgggaagccgccctattgtagagttccctaaaccttgggacatgggaagaaaccgtgtctttactcttgcatcctctgggattgaaacgctaccacagcctggcagccagagttttgtcatcctctgccaggtctgtctgggcctggcatatccaacagctcagtccctgtttttcaaagccctttagcctaaagactggtggagggagggtgaggggaggggaaaggaagaaggaagagtggctggtctgtctgcttggaagccagagaaggagtgacgggtgggtgttaaaggtgagtgtgtgggggccaaggcctcctcccaaggggtcggatcctctccaggagtgcccagcagtatccgggggaggcgggggggtggctgtctgacctaaagccacacatgtaagccatgcctcttccattgtcacaagtcatgagtccccacagtgagctttacacatcccatgaagtcctgacccaggaattttgagaggcagattttggccacagtttccttttgggaccctttcacatagtcagcagcgcacagtccaaagctgt

SEQ ID NO: 2355 - DNA, 27 bp, Homo sapiens
attatgaatacagtctgtactccagcc

SEQ ID NO: 2356 - DNA, 409 bp, Homo sapiens
tgtgactgcacgtggacaggtgcagccggggtgtgctctgcctcactcctgggagtcacgtccacacccatccacacatacttggaaaatatgggtcaaaaatgccaaggagcaagttacttcaaaaagtgcagttgttctttgtcccttaggcctatgtccatggctctgaaactcccacgtgtctctggggtggacctgtggggtgttttaggacaagattatgcagccccactgggtacagacttacgtttgacatcagggatacgatacccagcagtggcactagctcctccaccccactgggactattcctctgggttcttcccatctaggagtttattccgtgccctgcacttggtaatatcctacaggccaaagccccacactaacagtaaagagagcatga

SEQ ID NO: 2357 - DNA, 789 bp, Homo sapiens
cccatggactctgtctccactccacccacctcacccccaggtggtgagctcctccagagcagagtggctgtgtccatctctgggcctcccgtacaaggctgtgccaggccagaggagggcctccatgtggctttactagaatggcagacgctgtgaagctcctgatggaggtttctgtctctgccaatccaagtcttcaatccattcaccctacctcctctgtgggagaaacacaaagacacgcaagacctcaccccctctcagaaaactctgtgtggggaacacaagcttgtaagtcctggtgggacacatggcacgcaaaatgcaactatcttgcaaaacctagtgcctcctagggagtccagggcaggcttccggcagaagcggcattggagtgtggcttgcctttgaccagtaaaagtggtgaggaggaggaaacagcatgaagaggggtgtggaagcaagaaggcagatgcatggatccggcagggcactgctcgagcaagcgtcagctgcacaaagtgctgctgggaatgtctgaggggctgggcccaggagagccccacgatcctgcagtgccaggctgaggacactgtgtctatctgggatcgtgtgtgcagagtataagttcccagatgtttggggaacagaacttcactgtgcatgcacacacacacacacacacacacacacacacacacacacacacgcacttcttccatagggagaatctgatgaacaaatgcccttccatggataaaccacatcatcatcactgttatcccttac

SEQ ID NO: 2358 - DNA, 357 bp, Homo sapiens
cccaagctgcctctctcaccctgcagagtactcttcaatgtgtacctgtaggtgtggtggtttctggaagggagtgactcctctcctgcccggagccaagcccattcagaagtcactttgggaggcctggcctactgttggacaaaagagagcctagatcagattgaaccccttcctaacgcctccttctcaactaaatgaagcaattcacatctggtggggaaggaagacatctagacagtccacttagggcagagctcccccaacccagcatcctcactgaggcacagtcattggaaaagcttggacttcacagcccatccctgcctgcctcttcttgtgtctctgcaggtaagg

SEQ ID NO: 2359 - DNA, 506 bp, Homo sapiens
cctgttcccattacccacagcatcttccaggaggtggcatcccagactggccaacattgcagttgggagtatatttcctgcttcacccctcgtgagccgccagggtcaggtgccacatccccttcattctccttgcctctttcacagcccctcctgccccatggttgatcccaatccatctgaactgcatggagtccacttggccctgctctcaggacccagagcttggcctagaattggccccaggaccctcaggaaggccttggaagcctggctcagccgggtttcaaggcaataaaagtaactgagacctgagcagccccacactggctgatgtgctgcagtgacacctcagtctctgaggcctgtggcaagggctcctgaaggtgaattgacccagggcaatcctatctgcttacaatgtttagccacagtcaaagatagcaaggcctaggggcagggatgggaagacgcgatattttagggggttcagtctgaaatcacaa

SEQ ID NO: 2360 - DNA, 489 bp, Homo sapiens
tctgattaacccactttttctccccagttgttgaaaaaggaaagtccttgcttaaagggaggataaatggtacgttcctggatttcttcgtttgatgatgacctgtgatcccttgtcttcatgtctccagcctctatttttacactcttaactggatttctcagacttattttcactggtcaaagggcttttccaccattaaatcctctgtgccagacagcagccagacctcccctgcagtgccctctgctgccatcccagtcctaggcacaggcaggaaacccaggtgtgcacacccaggccgggtctcccacaaggaagtcatcaggttaaatagcagaggctgctcacccaggcagcctgattgtcagcatgagtttgcagtggcctcttagtttgccctccagtacccaaatccatcccctccaatccatactgcaacttcatctcattgctttctaatcgtggccaaaaattctaaaccgtccc

SEQ ID NO: 2361 - DNA, 48 bp, Homo sapiens
agcatggtattcctaacctgcttggctataacactacctgaagagaaa

SEQ ID NO: 2362 - DNA, 143 bp, Homo sapiens
tctgacttggcaaactggagaagcactcttttcgtgtaccttgtccactaacagacttctgcttagtggtcaccacctcagggaagtccacctgacactcctccttcccataagagcgatgacaacagttagcatttatcaag

SEQ ID NO: 2363 - DNA, 73 bp, Homo sapiens
gggagggatgctgttgtgatctctatcaaagctaaagtaatggaaggtctcaggaagcacagagaggttgagc

SEQ ID NO: 2364 - DNA, 61 bp, Homo sapiens
gtcacctaatgggccagatcactcttggcaacagcatcatcatcttgtggactgaggactg

SEQ ID NO: 2365 - DNA, 552 bp, Homo sapiens
ggcagaaaaaggaggagaaaggatgatgggaggggcctgtgagtgtggagagatgccctgggtctttgtttggggatgagaaagaagcaaggagaggcaaaggatgggatcgagttaaacagaggaaggggtctcagctttcccaaaaggatcatgttgcctttttctccggcaggtgcaacctggccccagtacaggagtatgcccgggatgtggggctcaagacagacctggtaaccatgaacccctcggtcatccagcgggcctttgaggacttggtcaatgccacgtggcgggagaagctgctgcaacggctgcacagcctcaatggcagcatcctgtggatccctgccttcatggcccggggcggcaaggagcgtgttgagtgggtcaacgagcttatcctgaagcaccacgtcaacgtgcgcactgcatacccctcgctgcgcctgctgcacgccgttcgcgggtgagcggcctccctacaggccagtaggaccgtcactaagtgtgggagattcttggtaggcagtatccctttcccaggtgcat

SEQ ID NO: 2366 - DNA, 39 bp, Homo sapiens
aggtgtgtgattttcaagaaaatcaggatcagatgcact

SEQ ID NO: 2367 - DNA, 575 bp, Homo sapiens
tgcggtagaaacatttaatgttatcatcaatcatcgctatctttatgtctcagtgcaatattctctaactctacagagcacatcttactgattgggctgagatcttcaaaggagcgtctcttaggatatgtttttgtccacaaggtcttctctctaagatggaggggaactttacctaggcaatatgaaagagatagggagagttaaagcaatggaatccactctctttaagaagagttttgatgtaactaattaggtaaggattttcctggttaggcctggatctctaattccaggaaagagattccaagaattaaggaaaacaaataggaaatgttgaggagggtctgaactattcctatcaagaagtccatgtcaacctggatggcattcttaaacagccccagccaaacaagtagtagttcccaatctcctccttgtttcctcccattcatgtgacctggcatagatctccctggcacttggatcagtaaattggctaggaatttactagtgcccatgatagcagccacaagaaaaatagtttaatattaatcattcattcactctcttcc

SEQ ID NO: 2368 - DNA, 106 bp, Homo sapiens
tgcagtcagactggctagaagtaaaacagtggggggctgaagcagctggggttgaccatgcgtctctctctctttatgttatattagggtttctccaaatgatctc

SEQ ID NO: 2369 - DNA, 465 bp, Homo sapiens
gatggctggctatcaccaaaataaactaccatagacctgaggtggaaacaccagcgaatttcccaaatttccattgtgaacatccaaatgcccatttatatctgagtgttccttgtattcttataaaatgaaaatggagcctgacataccaggtttttggagtcctgaaggagatgtggagacagatccttctgcaaggaatccaccgaaaggggagcagcctcaccccatgcaggggctggagatgctcccacaggggcagctgtagcatggacgctaccaacctccaccctgcacatcctgcacaaacaatcactctttcacccctccttcagcttatcaaagttgacacttacgaagccagcacagctcacccttgtcaatcagactccttcaaacctccatcaaccacacaatctcaacataaagaatctccccaacataataataggaacagtagctatg

SEQ ID NO: 2370 - DNA, 42 bp, Homo sapiens
gtcttgtcttaccccttgaggtggcaggtgctttggagtaac

SEQ ID NO: 2371 - DNA, 298 bp, Homo sapiens
cagtccagtaaactgaaaacaaaaccccagaagtaatcacacgtactgcgggagaggagagagctgtctcagagggcacagtcttgttgaaattcctctgctccttgggaagaaacagcccagaaaaggccccaggggctgcgtctcatctgggttcctggatgaggcacaccccctactgcactgagattccacagaagctgggggtgaagtgcaaataccgtctttggttcatccttgggattttctttttatcacacactcgtcattttgtccacaatgtccaaagtttctaaag

SEQ ID NO: 2372 - DNA, 603 bp, Homo sapiens
tattgcatgctcaggaagcaaagtaattttgcaattatacaactgttaaaaatggaagaattatgtactgagcaccattttctctgttgtttatgctacaattcaactttctctctctctcactctttctctaattagcaatgatcttctgtctggtccaaggtcacacatttccagtcttccagaaatgtctgttgaatctgttaatttgttgccaggaagaatactcaaacttctcatgctcatatttgagtgttagctgtctccagccagcatttctaagccagaccctttgtcaaggcttttgaataattttgtgaaaagtacccccaaagatgacagtgttcactgttggcagcaggactgtttccatgcagtagggctatgctgggtgtgcagtggagctgtgcacactgtgctcacggggcagattctgtgctgctgactctgatccctgtgcttgggaggaccgtgtccactgctgagtctacatctgaatttgattctcaagaaaaaggtcattcatagctattggacactgagtcacatagagggacagaaggtggctgaggacaccttatctctgatgagcataaggggatt

SEQ ID NO: 2373 - DNA, 160 bp, Homo sapiens
tagaggtgaaggggattgggaagctttcatgttctctctcaccatctcccttgcttatctaacacactcttacacacctactttattggagcttctgctctacaaacatggctgagctctaaattagagacttttgaaagtgcagacggatgcaggaact

SEQ ID NO: 2374 - DNA, 707 bp, Homo sapiens
atttcaaagaaaactaaatctttggatgaaccacgacagaagagggaaggttcacacatttccctgctgcttgggcctcagtgaggactgactcagccagtctcaggctcctggagaccgcctgggagatctgcactaggaaaccattttcagcacagcctggggctggtaaggggcccttactctgttattctgctgcctgataattttgcatccagagaagaattaggacctgtgagtccaggaatttcaaagcccatagacaaggtcccctcattctgccgtgacagcctcagctctgctttcccaaaaaaagagcatcttcccagcatgaagaaccaggagcaaagagggagcttctcccaggggtgagcagggcagaagccaccttggtcagtgggaaggaaacatgctcagctcacatctgacccagaatgactcagtcacacctgtgcagggtcacctgtgtgtgagcatcatctatttgctccatgagaaaataccttgtgtggctcttgggtaaaatcataccataggtgacatttctctgcctattgcttcagccgatgcttttcgtgattccctttaggacactggcataaggtaagcatgtcaggtgtgggacgtattgaacaggaaaagcagaggcttctcatatcaatgctcgtggcttgtatttgggcccatacctcatggaaatgggaaaa

SEQ ID NO: 2375 - DNA, 3088 bp, Homo sapiens
tgtcagcttaaaggatcattaaaaggcctatgtttgattgaaacctggagtactgtactttgagtcttctaatcagccaatgagtgcagggagctggctgccctcccaggtcctgactggctccatgtccaggtagagcagcgctccccacaggcagctggaggaactgacgaggggaagctgttggcatcagggcctcaaaaatttgactcaggattttcccacgtcccctccccaagtccaggcgggttccaggacactcagaagagctcatcattatgggtctaggacttccctggtcctgctcttctttcttccttccccagtggccttaagattgtcactccctgtcacaggcccttcctttccttgtcaagtgcactccctgaattctctgctcctgggtcaggaaagctctggaacttcagggaaagcagtgctgggtgacccaatggggacccagaaagctggcccagggccagatacacaggcagcagggtgggtccctacagtgctgcctggtgggcatcaggtagaggggagtgaccaggaccaactcccctgagtgtcttcagggccaggtgaactagggagggtctgggacctggtgtggacccatgcactgacccaggaataggacaggaaactcctcagagcaaggactgtgttttcctcatgctgagctcctgaaaagcagtcttgccaggatagagtgggccagggtggatatatgttgggtgaatgagcttctgtctctgttttattgcaggagtcactacgaaggtacgctggccctgtatttgtatccagaaccagtcaaagccacctgtgagtcctgcatccctcagtaccaagccccagtcccccttcaggaccacccaccacacagagagacagacgtgcagggagcctgaggaagaacctgaaacctcctctactacatggagtgtttgtatttccatcaggaatcttgagcaccttgtgccgggtcttgaggcaggaaggggccacacagagaagaggagtttcttccctgaggtcagcagtccatgaacgaagggatcagggacttgagcagcagattctgaagcaacacctggacccaggaggcccctgagcctccagcagcccgcgtagagtggccaccagggggcagcagagagtaacctggcagaagcacctggagatggggtgggcctgggcatcagggagatgcccacatgcagggagggtcggtgaccatgacctgagatctggagggaaagaggttcttcttttcttagagtatttgtccttgacaccgatgtttacattcttctggcttcctggttctcagatctgactcttggagatgatccttatttttctgacacacattcaggcactttgcctcttcccatcgacctggcccccatctcactgtcacacatgccatcccatcctgtagtcagacgtgtcccacctccctgcctttgctctgggagcccctgtcctgcagacacagccacttctccttccctggccacccctcaacgtccactgtccccggtctttcctgactctgttctggggaacctgccaattcgtagttcttgatttccttatgagacacacaatacttactcattaatcttttgttgacttaagtttttatccattgttacattttcccagcaacagaagacaacttagttataataaacacttacttcctgggtcttggagtttgcagccccctctcattttctcatgaagcaaacatttccttcacctcctgatctgtccctggtcctgacagcaccctggtgatactgaggcacagcacccatgacctgacactagaactcgcagccaaggtagaaacttaccgcatcccatggatcttccaaaattctatgtgcccttggcaaccaagaattgcattctcctctagcacagaggagctgtgccctggaatggggcctgtacctgtccaaggcttgtgccgtcccctgtgggagatgagaagcgtccctgcattgggctcttggggacccgtcttggacatgagtgagaatgaagagggtccctgcattgggctctggcatgtgactttaaatggatttaggcctgtaccagacatctcatgtctgacataaaatatttacaatcaggacattactagagaagcagaaaaaagctaaccacctccctcctgagccaggatggaatgaaggaggggactgtggaccccagataattcccctgtcaccactgtgactctaacaacctcttaaatcacggccaacatctatcccataggaaggtctttatatcccctagaaaatacagaggaagtcagctctgagcttttccacgaccaacccagccaaggagcaaggctgggcacaacctgggtaaagatgtgagcccagaccatgggaccagtgggtgaaggaaaatcgcatgggctgagggggtgggtaagcaggggccagccctcctctctctgtttcctttggggctgagtccttctctggaaaccacagatctcctccagcagcagcctctgactctgctgatttgcatcatgggccgctctctccagcaaggggataagagaggcctgggaggaacctgctcagtctgggcctaaggaagcagcactggtggtgcctcagccatggcctggaccgttctcctcctcggcctcctctctcactgcacaggtgatccccccagggtctcaccaacctgcccagcccaagggttctgggtccagcgtgtccttgattctgagctcaggagggcccttcctgtggtgggcaggatgctcatgaccctgctgcagggtgggaggctggtggggctgaactccccccaaactgtgctcaaaggcttgtgagagcctgagggactgcacctgccaggagagagtagtgagttttcagttcaaagtctccatacaacaggaaagtcatgggccactggggctggggctgattgcaggggataccctgagggttcacagactctctggagcttgtctgggacagcagggcaagggatttcataagaagcatctttcacctgcaagccaacctctctc

SEQ ID NO: 2376 - DNA, 810 bp, Homo sapiens
ttatctttgcaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatcccacggtgacacaggcagatgaggaagtgagacaaaaacaccctcccagcctcggtcaccctcttgctccagccccgggaagcctgttgataaagccatgagtgaatctggcccagttcacctggatctgagcctttcaggttgcccttccctccagccccctccaggagtctctacagaagatacatcaggcataaatatggcctggaagggccagaatcatctggtgacttggggctgttgtgtgagttagagaatgaaggcttgggtggaaagacagacagaggcaacctctgtccactgtcctacccctggatggtcatatggtggggacagggcaagtccttagaccaactgtctggatcaggccccagaactactgcccagttctgctgaggtcctggcccccaggctgtgtggcagcctgtgattcccaacagagcaaaccagaggaatggacactgtgaagtctgcccagatcccctcctcaatgtgacc

SEQ ID NO: 2377 - DNA, 95 bp, Homo sapiens
gttgcagaaagcttcctcaagtttgtgtcccttttcagaggggttcggtttaatcaaccaagatctcaaatccttgcctcaatttaagatgccac

SEQ ID NO: 2378 - DNA, 507 bp, Homo sapiens
tggccagctgtccccaacatgggtcatcagggacctgagtaggccactataaactgaaaactctggtttctgtccaaatttgcagagtaaatgttgaaatgcccaatctgatggttccttgaatttttatggaatgaaaagggagcctgacatgccaggtgctctgggttgagggattgttggagtcagatctccctgcaggaaagcccggggcagggggagcagcctcacccctcacaggaaccacagatacacccacaaggtgagctgcaggatggatgctgcccacctccaccctccacatcctctgtaaatgttgctcctttctacaactccaaccagatatgtagatgtggcgaactacgtaaaatacggatcattcatcacatcaaaacccactgcaggacaccctggtcaacaaagaacccaatcacatccccatcaactacatagtttccaaattttccatctccagaaaaataacaataacaatatacatgaaaatcg

SEQ ID NO: 2379 - DNA, 137 bp, Homo sapiens
cctcacaactctttcaggtgacaggtactgttgagtaacctgctgcaagcatccccatctccaccagaccatataagtgtgaacccaggaagaggcactggaacaatagagagaaaaacctgcttgtgcagaagacg

SEQ ID NO: 2380 - DNA, 190 bp, Homo sapiens
cccttgagccctgctcctgctccatcctacgggtgccacattcatctcatggtgtaatatttcgtgccctgcctgagcttatgaccgaggggatatggcaggtctgactgtgtggttactggtgtctcatgaggttctggatgtaacaaagccctcgaatatagaagaggttgttttcaaaaggaaataa

SEQ ID NO: 2381 - DNA, 292 bp, Homo sapiens
aaacactgggtgacacagttctcagacccatgatttatagtgtcagtattcaggcctcaggggtccctgatggcttctctggctccaagtctggaaacacagcctccatgaccatctctgggttccaggctgaggatgaggctgattattactgcaactcacataggagaggtggcactttccaccgtggtccaagttcatggggaattgagacccaaacctgccctgggctctcagcctctctcttgttctgaagatgcttcctcaccctgtgcaaggggcttcttgcagc

SEQ ID NO: 2382 - DNA, 1531 bp, Homo sapiens; identical to SEQ ID NO: 1958

SEQ ID NO: 2383 - DNA, 2217 bp, Homo sapiens; identical to SEQ ID NO: 1959

SEQ ID NO: 2384 - DNA, 714 bp, Homo sapiens; identical to SEQ ID NO: 1960

SEQ ID NO: 2385 - DNA, 1308 bp, Homo sapiens; identical to SEQ ID NO: 1961

SEQ ID NO: 2386 - DNA, 100 bp, Homo sapiens; identical to SEQ ID NO: 1942

SEQ ID NO: 2387 - DNA, 422 bp, Homo sapiens; identical to SEQ ID NO: 1943

SEQ ID NO: 2388 - DNA, 229 bp, Homo sapiens; identical to SEQ ID NO: 1944

SEQ ID NO: 2389 - DNA, 21 bp, Homo sapiens
gggccctcagtttagcattct

SEQ ID NO: 2390 - DNA, 277 bp, Homo sapiens; identical to SEQ ID NO: 1946

SEQ ID NO: 2391 - DNA, 587 bp, Homo sapiens; identical to SEQ ID NO: 1947

SEQ ID NO: 2392 - DNA, 982 bp, Homo sapiens; identical to SEQ ID NO: 1948

SEQ ID NO: 2393 - DNA, 136 bp, Homo sapiens; identical to SEQ ID NO: 1949

SEQ ID NO: 2394 - DNA, 85 bp, Homo sapiens; identical to SEQ ID NO: 1950

SEQ ID NO: 2395 - DNA, 430 bp, Homo sapiens; identical to SEQ ID NO: 1951

SEQ ID NO: 2396 - DNA, 1090 bp, Homo sapiens; identical to SEQ ID NO: 1952

SEQ ID NO: 2397 - DNA, 356 bp, Homo sapiens; identical to SEQ ID NO: 1953

SEQ ID NO: 2398 - DNA, 51 bp, Homo sapiens; identical to SEQ ID NO: 1954

SEQ ID NO: 2399 - DNA, 280 bp, Homo sapiens; identical to SEQ ID NO: 1955

SEQ ID NO: 2400 - DNA, 307 bp, Homo sapiens; identical to SEQ ID NO: 1956

SEQ ID NO: 2401 - DNA, 310 bp, Homo sapiens; identical to SEQ ID NO: 1957

SEQ ID NO: 2402 - DNA, 1111 bp, Homo sapiens; identical to SEQ ID NO: 1962

SEQ ID NO: 2403 - DNA, 1140 bp, Homo sapiens; identical to SEQ ID NO: 1963

SEQ ID NO: 2404 - DNA, 33 bp, Homo sapiens; identical to SEQ ID NO: 1964

SEQ ID NO: 2405 - DNA, 157 bp, Homo sapiens; identical to SEQ ID NO: 1965

SEQ ID NO: 2406 - DNA, 1092 bp, Homo sapiens; identical to SEQ ID NO: 1966

SEQ ID NO: 2407 - DNA, 227 bp, Homo sapiens; identical to SEQ ID NO: 1967

SEQ ID NO: 2408 - DNA, 458 bp, Homo sapiens; identical to SEQ ID NO: 1968

SEQ ID NO: 2409 - DNA, 114 bp, Homo sapiens; identical to SEQ ID NO: 1969

SEQ ID NO: 2410 - DNA, 489 bp, Homo sapiens; identical to SEQ ID NO: 1970

SEQ ID NO: 2411 - DNA, 1022 bp, Homo sapiens; identical to SEQ ID NO: 1971

SEQ ID NO: 2412 - DNA, 20 bp, Homo sapiens
tgtgattttttttatgacaa

SEQ ID NO: 2413 - DNA, 474 bp, Homo sapiens; identical to SEQ ID NO: 1973

SEQ ID NO: 2414 - DNA, 867 bp, Homo sapiens; identical to SEQ ID NO: 1974

SEQ ID NO: 2415 - DNA, 127 bp, Homo sapiens; identical to SEQ ID NO: 1975

SEQ ID NO: 2416 - DNA, 214 bp, Homo sapiens
tttgttttttgagaaaggggcgcgaagcagggtgcgaatggatccctaaattcaggtcgtggctggctttcccagcatccagtttctgcttagcaaagatccaagagagcttccccgtaacttttggatttttgtctgagataagggttcaaaagcagagcattttaatgtcatagatagttcagatggatacattagaattaagttatttgaa

SEQ ID NO: 2417 - DNA, 765 bp, Homo sapiens
caataacaacagtaaaagtgctaaaatgccagtaggaagtggtgaaagcggtgctgcaagtgggtggggaccagaaacatcaactttgagatgagggcaggcagggtagctttaatttgttcccagtggagcaggcccctccaggaggagctgccaccggtttggggagcccacaggtcctcctcccaggtctggggcaggacccaggcaggttgcgcacctgagcgacggcccttgtcctcttattttctgggtaaggggctgcccttttcccgcacaacagtggtcaggagaggcagtcactgacttgaggtgaccagggaagagcagggccatccgtttcttcggaaaaaaaaaatcagagttttaaaatcagagacatgcccagggctgaagcctgaagctgtttcttcctctgtgccagataacctcaggatccataattctttggaatctcaccctgccgaattactttctttcaaaaataaaattattttctgataattacggtaatgtacattccctaaatttttgaaaaccatggaaacatgaaaaaggtgtgtgtgtacacacaatggagacacactttacattctgtaaatgctgctttttcacatcacatgatgacagtttgtccacttttaaaagtggttgtaatgactgaacaatattttacccattttagggatgcacagttctttagttaactattcccttcgtgttgaacattaaggcagttctacttcattgctcctgtaaagaatg

SEQ ID NO: 2418 - DNA, 152 bp, Homo sapiens
ccttcacagaataccctgggtctcagcttccacactggaggagaggaagttgctgggaacatcagactgggacaggtcacccatcctttgtttcttccagtattgctcctctgcaaaccttagggccaccatcagcagcagcctccaaacca

SEQ ID NO: 2419 - DNA, 532 bp, Homo sapiens
atatctggcctatggggaaagtggggactgtaatccagcttgaatgttgctggcctacctgtgtgtaagcataagtctgtgtccattcttctaattcactcaaaggtgccacatggattagacgaacgagtggtcctggtagcaactggggcctgagggggtgcatacatagaaatggaatactacgatgtcgttttgattttttagttttattttaggaatatcctggcttagatttggctatgatttgtgctttactctcatttcaacactttaccatcagtgggaaatatcactgttgctttatgtgcaaagtgatggttttaataaggggtaaagaggcatagttagttgaccactgcactttcatctgggacagcacctttcttacccaaacaggatcatattgaagctatgacttacatggtttgggatcttagttgtatacatttcaaaaagcgatgttaaacacattgagctaggctgaaaaaagtaatttagaaagaattttacttcctggttcgaagtaaat

SEQ ID NO: 2420 - DNA, 1434 bp, Homo sapiens
taagtgctaagtaaatgttagattttatgattatatccatttataaaaccagcagcatttctcatttccacttttttcttctttccagtcttcttacataagatacttgttcatagaatcccagtctcatttttctccctgcatccacaacctcttcatgtttaactctccctaaggcactccagatatttactgaaaaaattgagttaatagttattcctgggttcttcctttcccaccctggtctctcagcaacttttcttctagtttttggattctttgcctccccattctctgtcttataggtggggatcctggaatatctttcataacctgatggtagcagttgccttcaaccagagcctgggcactacattacaggggaaaatcaggcctcattgctgtggctatgaactggtacccctcctcttcctgccccaacgtaatcgtcctacaggccccttcagagatgttagaacttctacttttctggtctggagttgagctctgtttcttgtgccaggcagtgctggctggagtagcagaggggaggagacactcacagagcagcctgggctgtagcaaaggcagagagtaccacgtggtgctgataaaacaaaggctttattttttcatagggtcagacacaggtgatgacaactggctgtgcagatattgcacacactggcagataccagggttgatatcctgtgggatcctggagaatggacaggaagagccactagggatacctcagagctctctgcgggggaacttctcagtgctgaccaaaggaaaggagatttgagtatgagagagcaaagcagaccaggatgctccttggactttctttcctctaaagttgcttatttcagcataaagatccaggtcagtggcagcctgagcccccaccttgctgaccactgcccctgccacagaagttggagctgtggcacttgcattggcgggacctgtggcacctgtggtggctcagggagcacagacactttgtgtcccctcaaagtgctcctgtcactcactctcctcctcctgagatcaggtgtccacagtcctcacacacacaggatttgtctgtgatgtcccctcaaagaggggacacaaagtgttggaaaacacagtgctattttccccagttttgctggtgatggaggccaagagaatgtcagctgggcagaaagtcagtctaatgaagctgtgtcattgtggggctctgggccttctaaagggtccacctcagtccctagtccatggctgtagatggagacaccaccttctgtgtttctttatcatttggcttcagcctcctccccttcctaatggccagcaccagccctcctcactccatgaaattcctcctacttcaagtccttcattcccatattccttcattaataaatttctattgagacttag

SEQ ID NO: 2421 - DNA, 722 bp, Homo sapiens
gcatcaattatgggccaggcatcatggtcagtagtagtgatagggtaggtaagagaaaatcatggcatctgtcttcaatgagcttaaagtctagcagatctaacaaacataaaagagtaaattgttagggataatggaccccagaaggagttccatgtgctatgggcatgtagagaaaaggtattgaagtctatactttgttgcaaactgaatatttattttttcatatcttgcagttatcataagcaagccttatcctccagacagggcaaacatggcagccattttcctccatggcagccattttcctccatagattgcaaccctgagccgttggcagcaggggaggcaagaggtaggagccagaattaaaaaggaaaataaatcacacattttgggcaagtttcaaagaatcaaaatatcttttccaatgactttcagtacatcgtgttacctctgttttatgaaacacagtggatgactattaggctttcttccagccccattcttgactacctgtcttgaaagcctccccacaagacctggagagctcattaatctcctttctaccttagtgattgcccttgtcactcactctcctcctcctgagatcaggagtccacagtcctcatatgcacaggatttgtcctgtgatgacacatggtagctataagaccatgatctggtcacttcccttacagcacaagggcacctccctgaga

SEQ ID NO: 2422 - DNA, 140 bp, Homo sapiens
aggaaaaatttcatgacttagtcattccaattggtactataggaacaggcactgcaggacctcaggtttagctctttggagtacattttggacattccacatcagcaatcaaagatgagtaaacaaacagaattcttctc

SEQ ID NO: 2423 - DNA, 477 bp, Homo sapiens
ctcggtagccagaaagtgccatataccttcaatgtgcctaagtttcttatatggattctaattttcccctcaggttaagtagtattttgagctatttatacctctttagtctcctgagaaagttctggttggacccagtgtgtaaaagaatgttggactcgaatttttttcttgtgttgggatgttggctggagttgaaagataaaaataatatgtgccccttatccccttatactaaagtaacctcaggataagctgctgaaaatctctgcaggacttgctaagaaaaaacataactctatttctctggtccagttatatatctggaagtttgagttttgataaaaattttttaggtaggagagttattgtcctagaagacagtactatggtttcacccttatcttgtataggaagggaactggttgctctcttgtaacagagatcaatggaaaggggaggactcatgattcgaaa

SEQ ID NO: 2424 - DNA, 95 bp, Homo sapiens
taaagagatagagcaggatgttgagacataatagtagacaacatctgggaaggaagaccagcttgcacattcttcctagtgttgtgtttagaacg

SEQ ID NO: 2425 - DNA, 421 bp, Homo sapiens
tatttttaaggttctaacaatgtctttataacaagggatcatctttgggattctccaccttttctaacatcaatgaaatcaataaatgccaagattccatgtcacaaaggacaaaaaaaagcaggttcagggatgttggttgagggcttcaaaatgaccacatgtgggtaatgcaaaggcaataggaagtagaaactgggaagttcttgagggtgggagacatgttgggattttgggggccagataggaagtcttctagggagaggaatatcttaggtcaagaggtggaggagaggaagttgggtgctggatggtgagaatactgtgtgctactcacctgtagtccatggggagaaagaataaaggaaaacttttggggagtcagtagaagaccctgatcaatctgacccttgccaagttc

SEQ ID NO: 2426 - DNA, 100 bp, Homo sapiens
tgtggtaactctggaaatcagatcctgttaatgcttattaagggctgcagtcttctgtttgtttagatcatgccttagtctttctggccaccagccccta

SEQ ID NO: 2427 - DNA, 137 bp, Homo sapiens
acttcctaactcatttattgagtcattatgcttcaccttagggcatatgcagcctcttcacattaggggaaattcagcctatcaagtgcaacactgaaagctaaataacaacaacacaacaacaaccaatcagggat

SEQ ID NO: 2428 - DNA, 147 bp, Homo sapiens
tataattctgttaaatgtaattaatttctcaaatttatcaaagatcattatttggaccattattttcttagccaaaatgctggcctgccccagttccatccagggttaatctgcatttaaacagctctttgaaaatatttggttttc

SEQ ID NO: 2429 - DNA, 519 bp, Homo sapiens
tttcaccttaagttaaaaaaaaaaaagtaaaactactcagacaacgccaaattattgacaatctcaacctaccccacagaccccaaatcctggaaccacaaccccctaggccaattctcaggtcaggcagcaatttattcctgttcaattttatgcagagctcctggtggctctgaagcgccctagggaacagaccaggaacattctcatggtgttagctcacattgggccattagtgctcctttaatgtgagaacaaccgggaggaggaggggatgtggacccaaaactacaagaaagagtgtcctcgaagcctatgtcctaccgccccacgctgctgccaggcccgcaggaagatgacaggcccggcctccactccttctaaggtcgtcgcttagttccgacgtcgggatgaccctgtcatccacgcggcgtgaaggccaccctccccgcgcgcccgggactccaggtggggccccagtggacgagggaacgcggcgtcgcccaccgggcgtggcct

SEQ ID NO: 2430 - DNA, 717 bp, Homo sapiens
tcagccagctgcgtaaactccgctggagcgcggcggcagagcaggtgagcgggcggtgccggggggtgcccaggccagggccctgtcgcctgcggcgctgagggcccggggtggggctgcgccctgagggccctgccctgccctccgcacgcctctggccacggtcccttccccggctgtgggtctgcggcccctgcgtgcgcagcgctcctggcctctgcggccagcgcgggggcggagagaggagagtgcccggcaggcggcggctgggccggcccggaactgggtcgtggaaggatcgcggggagcggccctcaggccttcggcctcactgcgtccccacttccctgcgcccgcctgccgccgagccccggctgggggtgggcgcggcgcgagcggttaaagggccggtgcatttaaaggagcggtgcacgtgggtctctgaggcgtgtagcaggcgggggcgttttgttcttcttctctctcgccggagacctccgttgcgccgagtccattcggcctctagcaccgggtcctgggcatgctttccccgggaaggaggcgcgcgggggctctgcccgcacgtgaggggcagggccgcaggctcaagcctagagccggtttctgttagcagcggtgtttggctgttttatcaggcatttccagcagtgaggagacagccagaagcaagcttttggagctgaaggaacctgagac

SEQ ID NO: 2431 - DNA, 889 bp, Homo sapiens
catccctccgagcagacctcacccctgtttattgccttaataagtattccctttgaaaggtatgaacggtgttgagtgaagtaactgcatccctatttacaaatggagaacctgagagcattccatagagacgattgtagactaacttaactcagaagcgacagcctggggttgccaaggctgtctacgaagtaacttgattaggaccgaccccagcttccagtaaggaagcctctgatgcctctgtagccaattctgcagacacctgagcctccaaggccttcagccaagacctttggcggtaattggagtctcgggataagctgcttcaggtgtgtgagcctcaggttcttctctcctgaatgtggttgtgggcagccggtgactggcgcaggtgcagaaggggcctggttcttggccccacctcagagctgcgtcctcacgacgcccacgttgagccttgggttccagggcagagactggagtgagggcttgggggcatgttgctttgaagtgggatggatgtatcaggtttttggggaaaactctgtaccctttggtgttgaagtgcccatgtgccaagtcttgagtccagcatgttcacatgtggggagtgagtggcttgttcctgtctatttgaaagagcagcaaggaggaggaggagcaagggctaggggctgctgctggggtgcctggagctgtggtgcataatgtcacacctgtctcccctccgtagctgctcaccgtccccccaaggggggtttgcctcttgcctactttggcctttctctgttatcgatgttaataatgacatatatctcgcttatgagttggtcataataaaaagctatcttgtacagaatattagaatttaagatcttaagaattt

SEQ ID NO: 2432 - DNA, 399 bp, Homo sapiens
gtttttgcgcaggaggttcctgtattcaactcctacccgtgtctctccactactgctgggaaagttttgtggagtccccatgagcaacttcctgacaaacaaacaaaatttttttaaagaaaccaaagcagtgtgtgtaggtcacatgcagtgtgtctaatgaaaacatctctggcgggttttcagctgttgctttgactttcggacactgtttagttggggactgataagacagcaaatatttctgcaagtattcccacctgttctattcccagctgccacagctgcggaaaggcgggggtgaggctgagaggccccgagaggaacattttccactgggctccaatcctggagatgggatgaccatcatgttaatgtctggagaaaagaatgatttca

SEQ ID NO: 2433 - DNA, 234 bp, Homo sapiens
tggtttcacatcagtcctcaggaaagatcagatgtcagtgagggagatcatttcttgagagcctcttcactgagtgggagaatgggctgcttgttcatctttgtgaaaattctagaacgggaagaacaattcaaagggtgtccaccattctgctgtaccttaaccagaaacttactggactctttttaaaataaaagtaattcatgtttattctagaaaattagggaaaaaaaa

SEQ ID NO: 2434 - DNA, 459 bp, Homo sapiens
gagcatttgaattatttatcctaccagtcccacagcaggacactttcccaccctcccttttgccccagagaagcagtgccctctgtcctccccatgcccatatgtgggcactccccaccatggagccaaacctacctgggcaagtagcagagggagagcagagtgagccctgggggcaggagagagacttgagagttttgaggtgacagatgagctggtgagtgagtgattagggagcatttcttgacacatacctgcccgtggtgaaggcatgtgtcttgtgagtgtgctcccagaaagcctgtgtagtgtgtggtgggcctgcctgtgtgaccaaaccctggccactgggtacgtgaccctcacaagtgctgactgggctgagaagagctccttgatgggcagtttggagacttgagttgtaactgtggcttttggccatgggacattaactgatta

SEQ ID NO: 2435 - DNA, 202 bp, Homo sapiens
gatatgtcctttcatttgataatatgtttacgtggccatagtgcctggggctgggccgggaatggaaacttgatctctggggcctggcctttgaagccagttcatgtgtctggtggttcagcagatccgtaactttccaagaggcacatccataggctaccgtgtcctttctcactgtgtccctcctccatttcatcttctt

SEQ ID NO: 2436 - DNA, 1791 bp, Homo sapiens
taatcttgcaaggtatgcctgttctgctttttacagcagaggaaatgagctgtgtcagattagactgtctgaggcctcttggccagggagtatgtggttcaaatcacataggcaggcgatctgaaccctgtcagtctccaaagcctctgcttttgaccgctgacttgctgctgcttgtttaaaaataaatgtgtttctggagcctactccagaggggcgtgctaggggctccctctcccacttccccacaaaccacccttttccctggctgcttcaggaaatgagagaactctgcctgggccccaggcacttctgagtgggacagggctgttagaggtaagtctagagcctggcccaaaattcaggaggccccatcagagggcccctggggcctgtggtccgggagggtggtagggcagtacctcacttccctttgagactcaggccccagctctggcttaggccagggagaaccatccccaagtggtatgtgttactatatgagctgagatggatggtcagctggaccaaatacatagtcgggtacccagggccagggggaggaaggtgagcagggaagctgtgggcaattgtctgggtatcacctgaccttagcaaactcttccttgttttaagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtggtaagtgcagtgactcccaacctgcttttgaaccctctttttccattaggattttctccgtggaggcagatttccatgggagtttgctgtggcattttgaaatctgtttcttacctagttccattggccttaaatgttaaggccaaagcctttacatttctctgtaatgaaaagaaggtcgaggaaattgggtcattgggtttccataatgattgcaggaactgctgacacaagcacggctggggagattctctaggtcagactcccttggtttggctaattcagcagtttgatcccattcagctgattaatgggaatgtgcagtggcttctttggatgtttgattttgcatcctaatccaaagcagctatcagcctcagcacttccttgttggaaggctttccagaacgtagtctatgttggacacttccttctgcctctctgcattttcctgccacttctctagagaatggggtgcagggggtgggagacggggaaagctggtcgctgagtggctgatgggacttgacatcacccagccccacccccacctgcccgtgagtcagcctccggggagagttcatcgcgtcaccggcactctaatgtggacagacacctagcagtgttgtttatctgcacacgtttgggtggtgatttttccctccaaggatttcagagcaccagcaggcttcagagcagacttaggtggcttgcaaagcaggccctcaggaattcagagggtagcagaagtccatcccagatgctctgttttccttcaggagctaggtaaatcagaggggctgagggacaaatgaaaaaagttacagcctttgagtcccatctgctcctcctggccaatgagaggggatctgggaggggcagatgtagaggaaaatctgtctaaatgttgatgctcgttattttcctttaaagaattaatagcctaaaataaaccctacagatacagtc

SEQ ID NO: 2437 - DNA, 662 bp, Homo sapiens
tttataaggacattcagatgatcaggttcgtaaagttttatgttcggttaaatttaacagcgtgtcattgttcaggttattaaatgtttgaaataagatttttggtggtcctgtcacagtctccatgaagtagcatttcaggatcgaaaggtatgctgtgtttaaagtgttgattcttactcctttcagttaaggccagtgcagtttgtccaggtagtgactgagacccagtttttccacactctcctccgcagtgggcattgttttgggcctttttcagcccaagagctctcttctccccatgccgctctgctggtctgagatttttccactcctcctcctccctagttgctctctgaccagactctaggtattcaggagaaagtgttcattgtctcactctctcatgtggcaatcaagtagtgccaagcagtgagagggtgaaggtgggtgggtgagggacactcaccttgctgagaaagggccccagcctgttcgggtgattataaagcagagacagtgccaggaaaagtctgacactggctgagaatcacccggggaccaaccatcccgaatgcggatccctgacactgggtgaggatggagcttggagatctgcattgttaataagcagcctagcagagtggtgaagagtccagaca

SEQ ID NO: 2438 - DNA, 662 bp, Homo sapiens
caggatgtttagtgccggctaagggctcagcaggtgctggtccatctccaccagcccccagtggcctgggccacctttgagaaacagtgatcctaagggattcagcatttcctaagttggtgcctcccacctgtcacccccaccccaccaggctaggagggttgtgattagagggtgcccttgctgtgacagctgagactagctcttccctgattattccttaatgacagctctctccttccctgctttcttgaagtcttggtcctcgttgttgtgggcacagcttcaggggaggccttggaggaatttttgaaagtggaatgagggaagcagcctgctcaagggaacacttgttttctggtgaggaggccgcatgtatgaatgacgtttgtgggttagaaagcatgttttgtagtttttccttgtttcttcctgaagacatgtcaggtcttgatgagaccgggcctgggcacagggcaggcagtcagcgagtgtggatgatgacgacagtggtcaccaggtcactgtctagaccaggtcactgtctagcgcagtgtcacatggaaagggtatggtcctttaaccctaccctccccagcacaactatcacagatgtcagggaacctctgctcacagaactgctttccagggattgtcttttt

SEQ ID NO: 2439 - DNA, 706 bp, Homo sapiens
acaggcatgagcaccgcacccagccccagggagcgtcttattagtggttggcaactgaatggagacgtgggaattgtaaggaactgattctacttgatcctgggtcccctgcttctccatcttcacccacccatcagctccctttctcctttaaacaggcacctttgctctctgcttatccatttttgttgtgcattgctatttgggagcctaagaaacacaacatcctctgaatgctccagctgttgtgggtctgaagggtgagcctgccctctgtcattggaggctgcagcctgtggctttttaggtacagggactcccagaactgctcctccagtcatagcagagataaatcacaggagcttaagaggcatgggaagaacagagggaggagatcgtagcttccctgttcattcacacccaaaacaaaactgtcatactagaaaaggaggtattaaaagagccacctgtacagcctcgtatctcatccagcacactgctgcagatggaatattatgatttagcttgagaaaatgcagcaactctttgttgtggtgcccctctttgagtaagagtgaattccccattgccagagtggatagtgagggaaaccctgggtccaggcaggagtctgtttaggatttatctagtgaggctgagccagaggaggaccttacagttttttctcttcaatttcttttattta

SEQ ID NO: 2440 - DNA, 910 bp, Homo sapiens
cttctcctgcatttccacctgataatttctctcatttccatagatgatgaaggaactaaagccaagaactttccaaggtcctgcagctctttgggggatgtgaagctgtgctctatttgtatggattttgctggttcccagaacttccctgtggccctggggcctagtctgagggtactctgagtgaagagggaggagggcccacacctcttctgcaaaggctgcttttgtaaagttcacttcagttcacatcttcctcctggtcagaaagcttcgggggctctcctctgctgcattaagctcttactcctccatcaggcaccaaactcctccctggcatggcccatcctaccaggtccccacacttgagccacatccaattgctcgatattatcaggataggttatgttatgttcccaactcatatgtttacttaagtggttacctctttccagaatgagccccctcctccaaactctgcctggtgaaatattcctaacctttgcagcttcacatccctcttacttcttgtgacctgaggcatctactcctgacaactgatagactgtgtcccctcctgtcgggtgcattgtccttgtcactaccctcctggcttttagctggctttgcttcccgctgttgttactcctgtacttgtctcatctatcctaaacagaaggtgctgcaggctggggagtttgttcatgttgaaatccctgtgatggaggtgagcagaggcagtctctgcctgtgcctcttatttggggatgaagttaaagtccctgtaggaataatccaggccatagccggggttgctgtcttcagaaagaagggcagccacaggtcttgttaaggggattgaaattggctgacttggtggaaggaacctgcctgctttgtttaaaaacca

SEQ ID NO: 2441 - DNA, 515 bp, Homo sapiens; identical to SEQ ID NO: 2014

SEQ ID NO: 2442 - DNA, 507 bp, Homo sapiens; identical to SEQ ID NO: 2015

SEQ ID NO: 2443 - DNA, 184 bp, Homo sapiens; identical to SEQ ID NO: 2016

SEQ ID NO: 2444 - DNA, 33 bp, Homo sapiens; identical to SEQ ID NO: 2017

SEQ ID NO: 2445 - DNA, 261 bp, Homo sapiens; identical to SEQ ID NO: 2018

SEQ ID NO: 2446 - DNA, 141 bp, Homo sapiens; identical to SEQ ID NO: 2019

SEQ ID NO: 2447 - DNA, 66 bp, Homo sapiens; identical to SEQ ID NO: 2020

SEQ ID NO: 2448 - DNA, 605 bp, Homo sapiens; identical to SEQ ID NO: 2021

SEQ ID NO: 2449 - DNA, 485 bp, Homo sapiens; identical to SEQ ID NO: 2022

SEQ ID NO: 2450 - DNA, 969 bp, Homo sapiens; identical to SEQ ID NO: 2023

SEQ ID NO: 2451 - DNA, 41 bp, Homo sapiens; identical to SEQ ID NO: 2024

SEQ ID NO: 2452 - DNA, 1027 bp, Homo sapiens; identical to SEQ ID NO: 2025

SEQ ID NO: 2453 - DNA, 506 bp, Homo sapiens; identical to SEQ ID NO: 2026

SEQ ID NO: 2454 - DNA, 99 bp, Homo sapiens; identical to SEQ ID NO: 2027

SEQ ID NO: 2455 - DNA, 576 bp, Homo sapiens; identical to SEQ ID NO: 2028

SEQ ID NO: 2456 - DNA, 178 bp, Homo sapiens; identical to SEQ ID NO: 2029

SEQ ID NO: 2457 - DNA, 26 bp, Homo sapiens
ttggatagaaacgcaatcgttattgg

SEQ ID NO: 2458 - DNA, 586 bp, Homo sapiens; identical to SEQ ID NO: 2031

SEQ ID NO: 2459 - DNA, 391 bp, Homo sapiens; identical to SEQ ID NO: 2032

SEQ ID NO: 2460 - DNA, 329 bp, Homo sapiens; identical to SEQ ID NO: 2033

SEQ ID NO: 2461 - DNA, 250 bp, Homo sapiens; identical to SEQ ID NO: 2034

SEQ ID NO: 2462 - DNA, 300 bp, Homo sapiens
ttggctctgtgtcaggtatctgctcccatttactgatgttttaggtttgtaggagtagagtcatgtgatatggaacatggccactacctttttaggaggtaaatggacagaaaacgttcccatgagagatggtatgagaacttcgtagaactttctgtatcagtagtctactttgcccaaacatgactactgcactctaagctatcatttaaagagatgttccaacctcagtggcacatcagaaacagtgtacagccatccagttgtccctcagcatccacatataattgtttcccggac

SEQ ID NO: 2463 - DNA, 128 bp, Homo sapiens
aacccagatagagagggctgaccatacaagctaagggaaagaatacatgttcctattgctgaacacaagaccccctgctgtgcagtgataatgcaatcttgataataatagcaataaaagccaccaca

SEQ ID NO: 2464 - DNA, 25 bp, Homo sapiens
attttttaaattttaacaaatatca

SEQ ID NO: 2465 - DNA, 320 bp, Homo sapiens
agagaaaggagaaaaaacataaccatgattcctccctcctctttgcacaatgagggttcctttttgtgattcctctatctagagggttgggtcatcatttgggattttaagtgcccacgcctccactggggcagcagtgcagacctgtatttaaagctgatctggaggcaggactaagggaataaaaagaggaaaaaataaacatggggatttactctggctttagggggctattttcctagatttctaggaaatgaattcaactaaagatttttgctattcgcaccttttacacagttccccattcgcttgccttcagg

SEQ ID NO: 2466 - DNA, 175 bp, Homo sapiens
acagtcgtagaatggatttcttattctctgagctgcttcttgttgttaatgattatacccctagcacttggcacagaagctgtcctgtgaaagataacctcaacctatttctaaatgaaataaatgaaaatgtaaaatgtgagactcaccaattgcctaataaactatggtagga

SEQ ID NO: 2467 - DNA, 1448 bp, Homo sapiens
catgtattcctgttttcaggacttggttattcacataaaaatccgagccttccttttccatttaactgaagtgactcctcttctcaaatttccatcctcccatcctctttcctgtaaaactccagttgattgatagatttcttctttgccaggaaggcttcttgagaaaaaaaaatattcttttccttcttatcaagttgtatattttcttaaaatataacttgactaatatgtttcactgagcgttcccccatctatactatcaagaatttattttagctttttatccttttggaaatgatgaaattggttaagattggtaattatccaactcaaaaatgatcgttagaattcctttttgtttgattaccatatatcaccaaacctactatttcttaccagctgtttccattaatttagccttgcttgtccttgactcctatagactcctatacttctcattttgaatctaagtgaaaatattaatagaaagaggtaagccttaaatacatctgatttaaattatcagatttgcttggaaagcatagctaaacgaacttcttttatggttttgcttgtcattttttattgccttagactgttttctatagagccaacaatctaaatagaagtggatatttttgttgtggttaggggcttggggtgactattatcagctctcagagataatcatggtacaaatatatcttagaagaagatgtgaggtagtgtttgtaaataatgtgaatgcatttacatgtgtttggacattcggtatgaaacacttctaggctacccaactgggtacttaaatgggagaactctttagaagcaagaaccttaggtcttcttgcttctaaaatggaaaatcgtgatggaaaaaagagctcccacagtatattaagcatgtgtgtggtacaaacattgagcaagaggagttgattgaaggtcaccagcttggacatcactgattccaaggtcatctgataagatctcctgtttgttcagacccatccctggcattctatctagcagtgccatagctgaaattagaaaaatgaagatgaaagcaactgactgtgacaatctgctgtgtacacaatctaagtgtatttttctttcttttctcttttcctcctggggtctccagtttaccgtggtttctgggcagtcctgatgctcctgggggtagttgctgtagtcatcgcaagctttttgatcatctgtgcagcccccttcgccagccattttctctacaaagctgggggaggctcatatattgctgcaggtacgtacggtgcaatgggtatgactttcagccacggtttttcttcatgtctttctatttttcatttctatattcaggcgtcagccttctagtaacagtaacacaataatatttgtatacaatacttcttgaacactaactaataatatttgtatacaat

SEQ ID NO: 2468 - DNA, 256 bp, Homo sapiens
aaaactctgtcactgactcactccaaggtgtgtaagagactgttaacctcttaccctattaattttctgtctgtaaatggggatcgtaacataagtctctgtaacatatcagcatatgatatgggtaggcattttctgagctcttcaaagatagccctgtgatgatatttatgataagcatacactcatgatttatcataggtacaaaaatatttttctacatcactcccattcattttcttaattgtttgttgat

SEQ ID NO: 2469 - DNA, 532 bp, Homo sapiens
taattaattaattgtgatccatatgaattatctgaatatattattttctgtgtgaagcttgcatttattttagttaggtttctaactaatttaatttctgctaaaatgatcacactacaaatagaaaagtaattgaagaggtgagtcttgtgaattttaagcccttttcatttaattaggcagtgaaagccagactattaacttggaaacataagcacaggctattatttgtaaagataattctagaaaactagccaaacttcagtatgactgagaccaaactgtacatactatgctgtattgtaacatcaaaccagagtgacagagtgctcctaggtgacactgtagtgacagttgaaggaaaggaacagaatggagaaggttactgtccttctaatcattggaaagatggcttgtgatgctgcccagtgtcatttcatcagtgctcaggtaacacaatactttctgcataagattgtgcttaattctgcagagggaataaaaataataatcagatctagatcctgtattt

SEQ ID NO: 2470 - DNA, 131 bp, Homo sapiens
gtttaaagagctaaaaaaaaaaatctcactctgagaagaaccctgttaaaccattctttcttttgtcttttatttgaactgttttctttcactggatttagccattagagctcttcattgtaaaagccttt

SEQ ID NO: 2471 - DNA, 126 bp, Homo sapiens
tgtggacttttgtgtctggcttttttcacttagatctgataaattatcatccctctgcttgaattcataattccataggaccaaatcccatatccttatatcccttaaaactgagcatcttcttgg

SEQ ID NO: 2472 - DNA, 143 bp, Homo sapiens; identical to SEQ ID NO: 2066

SEQ ID NO: 2473 - DNA, 130 bp, Homo sapiens; identical to SEQ ID NO: 2067

SEQ ID NO: 2474 - DNA, 2389 bp, Homo sapiens; identical to SEQ ID NO: 2068

SEQ ID NO: 2475 - DNA, 572 bp, Homo sapiens; identical to SEQ ID NO: 2069

SEQ ID NO: 2476 - DNA, 171 bp, Homo sapiens; identical to SEQ ID NO: 2070

SEQ ID NO: 2477 - DNA, 319 bp, Homo sapiens; identical to SEQ ID NO: 2071

SEQ ID NO: 2478 - DNA, 89 bp, Homo sapiens; identical to SEQ ID NO: 2072

SEQ ID NO: 2479 - DNA, 847 bp, Homo sapiens; identical to SEQ ID NO: 2073

SEQ ID NO: 2480 - DNA, 1127 bp, Homo sapiens; identical to SEQ ID NO: 2074

SEQ ID NO: 2481 - DNA, 65 bp, Homo sapiens; identical to SEQ ID NO: 2075

SEQ ID NO: 2482 - DNA, 136 bp, Homo sapiens; identical to SEQ ID NO: 2076

SEQ ID NO: 2483 - DNA, 342 bp, Homo sapiens
taagtccacttctttttggacccttaatataagtgtggttagactgtctaatggactgaaataaatatggccctggaaaaatatacccgaaaaccctcttccacactctgacctcatctagttgaaacattccacagttgaccccatgaaccccaaactccagcatcatagtagtgttcagggagatgaagaccttcctgacagaaccatgtgttagttcaggatctctaagaaggaagggtaaccctaagtcaaaccaattaaagtgacagttgacttatttctctgtatagaagaaccaattcagaagacttctgtgcagatattatgccactgctgacc

SEQ ID NO: 2484 - DNA, 603 bp, Homo sapiens
attaaaattttctctggtgttggggatcaaatatgctttaacagatcttgggcctttaagacagagatatgttggtttctccataaaatcagttcgataagtctgagttgtctcctttacaggcaggaagaaatggcttcccttggagctatccatggaacttatctaagggactcatgtttttagcctgcttctccagcttaggtctgccctgcttccaagtatttctagcacaccaagcttctttgtgagtcttgctatgactagtttttgaaatggaacctatgtttttcaagcccagaggccttacactgcaggttaatatttccagtcctaccctctacctattcatcgccttctttgtgctagccccatctttgccaggaatccgcccacctgccccttgtccaggcatattgccctgcccaagacagagactgacttaaagagtaaccaagactaaccttaaaagcaaccagtaagcatgatttaaggatgattggaaaacatttcctgcccccaaagtattcctccattttagacttggaatgtgacaatcctcctatttgggaatgtagcaacaaagaacaatgtgactggatt

SEQ ID NO: 2485 - DNA, 695 bp, Homo sapiens
gaatagaatctgaaataacctcaagcatccttagattcattgttgtttacatgtaagcaacatttggcatctggcctttaatatctctttgctttaggcacttcatcatttttatgtcacatgctcattcacccttgaccaaggctagggaagatatatgttctttgcaaactgactgattgagtacaggtgtaaagctatgtcatgaaaaacctttgacccctttctttgtcccaggtaacaggcaattaaatcagagtagtttgcttcaggccagaagatcattgaccagtacaaggcatctttacttttttttttagcttagagataccattaatgtcacagagccccgtagccaaaacgaaggacagttttgcaaatgatggatttaacctttgtcttttggaagctagatgtgattatctccatcagcttttgttcacactcttatagctcattttctagtgttttaatcttcagtcgttctaatttcaaagttccaaggctcagagaactaactcactctgcattaataactaacttggccagccaactagttagataatcgcttcttctaaagacctgaatttaatcacatataagataatacgcattggctcctaggattagaaagaaaatagacctttggggtgtcgggcactgtttagcctaccacagtccatcttctgattccc

SEQ ID NO: 2486 - DNA, 32 bp, Homo sapiens
gcacctaagaagtccaagatgatttagaatta

SEQ ID NO: 2487 - DNA, 21 bp, Homo sapiens
agcaaaccttatgtattgtag

SEQ ID NO: 2488 - DNA, 1601 bp, Homo sapiens
attggggcttgcagtatatacctttgtactgaaatggagttcagatgttttaacatttattccagaaagtatcttactgtgaattaagaagataccctggattaatacacaaatggaaatgctttttttatctcagattctgacatgttttcttcttagcccttattttaatgtattggttgaataagttgactgtctatcccattaagtcatgatcaccttacacatatacttgtttgttatatgtgtttcagtacactggaaagaaagacttcaggaagaaggctcagccctggtgaactgtgagggagggagtggggatgatggggaaagtcctggaccatgagtgagtatcagggaaaggcagtcttgctcactcacagggacacctaaaaatcattaaggggtaacttgttgaatgagcaggtgaggacaggtgctaacaagaatgatggaggatggtggaagacaaacattgtctgcttcttaatttaccctagggattcacctgaatggcacactcattactatgcttcccctgccaaagggcaagtacaaatagttaacactaggacgatgtcaaggaattagagaagagctgtggggaaatggaggagcacataggtccctgaaacaccagctcagagattgagtgttcataattatggaaaggcgataatagcctagaattatgtataatgtcacacctcaccagggcctgcagtgggaacttctgctgtgagtaaaacttgtcaattctgtgtatttcttcctctctctattatgtaagatttttatttaaatctttaataaagtctggtttcattcttcaacgtgtttccctaccaaattttaatgatacatttctatcaatcatcacatccatccgtcctttctagtgcattcccaacagtctcctgtttcctacccactgtctgtatgcttagactcaaaatagattcaagcagaaccaaaagtcatgtgaagaagtgaagtggccaaaatccctttgataaaagcatgaaaagagctaaggggcatcctgttgacctgccaagctgcaggtggtggccaagcccaccacaggtcttcctcctccaattagacccatttctccttcatagggggaattccagggggtgtgagtttgtgtgtgtagtatgtgagccatcttggcttatagctgacctgcagtgcccagaagggtgcaccacaagcattgttccagctccaaaagaaagaaaggagtccattgtctctttatgacagccaaaaatagaactgcccttttaaatactgcacaacattgtaaatggtccaatctattttctggcttactatatccgccggggcgctcatccacaatgttgctctctaggcttctctcaatctgtttgagtcctttccacacatacagcaagctacattttttttcaaggttgaatggcatttcatttttttgtttgttttaaactaaatttagcatagtgtgtctcaattcttaatggtgtctgcaacaactcccaaattagaaagctcttcaaacttcactagcaaagtgttgttttcttgcttttttcaaaccttctcacggtgctaac

SEQ ID NO: 2489 - DNA, 44 bp, Homo sapiens
ttactaattcctgtttatgtatttccacacaagcagttaccaat

SEQ ID NO: 2490 - DNA, 154 bp, Homo sapiens
gcaggaaactgaataaaattcaataacttgaataaatgtctagaaagatgctctgaccatagattttggtcagaaatattttcttatgtctctgccaacatgaaaacaagacacaaaatcagtggcaggtacttttaaagatatttataattgt

SEQ ID NO: 2491 - DNA, 1337 bp, Homo sapiens
attaaataagtgaacaaaaattggcacctagctagtcatcagtaaatgttagcttgtagtctactgatgctacacattcttcatttatttctttattcctcaactaggtattgagcccttccttgctgtgtgtgccagatgatatttctctgcacacttagttttaaaaggtttcatattttgtgtacccccaggatcatcagcgcccaaagctaaccaggcacttttccttctttcctgtgtttgaacaccatatggaatcaggattagtcactttgagccttgtgtgagttgctgttgtttcaaatgagtttgcaactgcagcatcttttgttttgttacagtactaccagtctatcttttcccaatatctttttcttcaaaatgctggaattcatttgattattttctagggctatttgagcacaccctctgtgtgaatgaaggaaaccaggttttactgcaggcatctcccatttacatggcataatttaaaattaaaggcttccattgcaaggcagcctctgtttcctgttccaccgtcttttctgctgataggttggatcatggactgtcctctcaaagtcagagcagtggtgcttgatggctctgtacacttaaggagatttgtttccagacccctctttccccaactattaattgtcttttccaagatactgtttttcccattcctcaacccttagaacttattctacagactttcactttgcttttgacttatgacgatttggtgaaacacttttgttaagccaggctgtactcacttggaagggcagttttttatacacagtattacaacctatataatacatttctatgtgaatatggccaagaagaagtactctaagctcaatgtcaaacctgatgccattgtgataaaacaaatacacaatgcctttaattgcaacagacgttttatgatctcaatatttctgtaaactcagtccacacagccagtgtagccaaaattagaatacattaagaggcataaaattgtaaattggacatgtggataagctttattgatattgtaaaatattatggtaagactttctgtcgagtctcctcatttttggcaccacattaaaaaacagagttgtgagtagtactgacgtaattagaagttgaacctgtttggattcacagtggtcactccagacaattacatttttaaaccttcagcagatggccagaattaagtcctggtgagccttttccacagcaccggagccaacatgcagtggatatgccactggcacagatttaacttcacctggaaataagctagtgggacggaaactgctgcagaacaaccg

SEQ ID NO: 2492 - DNA, 87 bp, Homo sapiens
agataggaagggaaagaaactgacaggtaataaggacatagtaagcaccaaatgtgttgtgaatgttaactgctttaatccccaaat

SEQ ID NO: 2493 - DNA, 74 bp, Homo sapiens
atggcttctgctggaataaataaatttaataacagtaacaataatatttctattaaataataggaaaaggagta

SEQ ID NO: 2494 - DNA, 421 bp, Homo sapiens
cagggtttgaacttgggcagtatgacaaaagagcttgttacttactaaccactatacgatattgcctctttgtaacaacatttggggaaatgcaaagtcaggttcccagttcacatggaagtgcttccagcctgagcttgatggggtgggggggctctaaggctcctcacaactctgagatctaaagcgcctcccttagacctttctcactcaaacctcaagctcccacatgctctatgctgtcactctgtccctgtcgtgtgtcagggaggatgcccattcaccaggccttctgtgctgtatgtcttgtgtgacttccctctgcctccatggtcatatgcatgtgcttacatccattagtagtgccaccacctaatagaagctcttcagggccctggggagtccaacctcctccatgagg

SEQ ID NO: 2495 - DNA, 261 bp, Homo sapiens
aagcatttatctcacatcagtgagtctgagaagccagaaccaagccagggtactccaggactatccccttttcccatagtttccaggagtacttctttgagaccttccaaggtccagaagggactggcaaggccatctcgaaagccactctccagttccttctacctccaaatgtccatcatggcgggctgctccctgtgactccaggaccctggtactcagcccacatgcccagtgcccaggtatgtgttgttagctgaa

SEQ ID NO: 2496 - DNA, 529 bp, Homo sapiens
gggtatggtctggcttttctcctgctgccccactttgggttccatattggctccttgacaaagaccacatggtaaagagaaagaaacttatcctctggtggggcaggagacccaggaacttgccaagtcaactgtcttctcaagaggaaacctgccaagtcaccatctgtaagtaggggcttcgggttgaataatattaataacgatattactagcagcctctttttcctaagtccttaggcactatagggtggattgggctgcttgggaacacgtgatctagattcaaatcctggctccaccacttactcatgaatgacctgggcaagttatttttctcaatttctttatctgcaaaatggagataataataatccctacctcaaactttccctgccaatttagttagtatggataaaagcacttacaactgcatttgaatttagatttagttgctgtgctgtctttataacctttgccttaattatcttatttaatgctctcaacaaccctctaaaatagaggctat

SEQ ID NO: 2497 - DNA, 30 bp, Homo sapiens
atatctcggctatacatcctcccactgcat

SEQ ID NO: 2498 - DNA, 296 bp, Homo sapiens
gtttttcagaagcactgcatgagatgctcccgggggtctcttgagctctaacattccacatttctacttctattagaatttcaatcagttgacatcctataggagaacagagagtttggtgatactgtttataccaagaaacagacaaaatcttgtggaaaccttccctggggcttactaacctcaccgtcacaggcttgccaacctcatcctcatcctcatcttcatctgcactggcaccttcacggttattgaagaaaggtgcacactctccagcagatgaattactgcattgt

SEQ ID NO: 2499 - DNA, 250 bp, Homo sapiens
atatcaggatttggttggcagcgtcttgtgtttcctagttgttcgtaaaatagtggggcatcctataatcagcagaatcctaaatgcaatgatacacaatctgcaaagctccacatccctgtccccactactggaaaacacaaataagaaaaaatcaccacctctgactggtggtggtcccaaaggccatcattttgtaagtggtcaccacattcagaatttttaaaaaatgctttttcctccaagacag

SEQ ID NO: 2500 - DNA, 225 bp, Homo sapiens
ctgtctctgaccaactctgcctggccccagagactaagaattaaaatgcagtcaaatatcactggatttcacatagcttctcagagcccgaaataatttcaagctacaatttcttgaaatgggttttattttttttaaaccccaacaaagcagattttttacagactaaaaatgccaaacagttgcctgcaactcaaaggcaagtgattaaacatccatgattta

SEQ ID NO: 2501 - DNA, 651 bp, Homo sapiens
gttgcggggaggattactctctcaacagcagacaaatgtagcaaaacatctattaatattgttccctgaagaagaatgagttagtataaaactgggaaggacaacagccatgcatctttctctgtcttcataaaatacagccttcctgaaaactgatgtgattacttgtgaagccaatgtttctccatttttttttcttcttcaatagctgtttgggccttaatgtgctttaaatgtgtaataaaaatataatgaaaaacatacttttattaaatgtggctgctacaacatacactataaagcctgaatcctataaagttgaattgtatggcatttcttaaacctgttccttctacttatagctgccctacaatattggtcagaatttagtgcttctctctcccacctttgccttgaattactatgcttgaacttgcagttcccatttctgctttttcctttttcttccatcttacctcccacactataccctaatccccctgttcttcacactctatcccccaatatcccaccacaaagaagtacatactacgtgtgacttgtcagaaaacccacaccaaaacctcacaattgggctcctgtatccaaaaacaaccttttatataaaaatgttaagcagtggagttagag

SEQ ID NO: 2502 - DNA, 184 bp, Homo sapiens
ggtcaaagccagatctccagagctggcatgcctgggttcacagccagctttgagatatcgtggaccacattcctctctggcatggactttcctccctggaacatccatccaggggtgtccattgactgcagttgctcccagttctcatgctttagagaacatcagtgcttttcccatctcaacc

SEQ ID NO: 2503 - DNA, 190 bp, Homo sapiens
aacccaccataaaagccattgctgaggcctcaggggcagcatatcctcacgcatctccaggctacccacccaacctatgcctgtgtgtttccctgtcctcactgggacacttgccttcgtgatttgaggacatttgattaacccagtctaagggctgaaaataacttttcttccttgaaaacaactgctg

SEQ ID NO: 2504 - DNA, 592 bp, Homo sapiens
cacactgtgtcaaataaagcaccctcaaaggaaagaggggatagaatcagagttagggaatattgagattttacatagaaatgtaaataccttgttaaagctgccatgttgctgttagaatacaattgcctcaaccaaaggcaactgaaagtgtttgaatttggaatacagagtatttattcttctgatagaattgctctgggatgtttaaagtaagagcagctctctaccttcgaagtttattaatgttactaggctgtcaatcaagctgttttcatttcttttgtcccagatgaaaatgttctgctttctctgcacttaagacatatcatttctcctcactagtactgcagagaaaactgtccttgtaatgccatatcaagtttttcatacttttgttttctttcatgtaaacatggttgacacttttaagttagtttgatctatattttataaggcatcaagtcagagacaaagatatttttaacgttaagccatttcaaatttactcattttgctgccattggttcatgcactcattcaatcaacaaccagttctggaacatttattatgtcatttgttaaaggtagg

SEQ ID NO: 2505 - DNA, 35 bp, Homo sapiens
aataattgtgttgcagagaccattggctatttggg

SEQ ID NO: 2506 - DNA, 82 bp, Homo sapiens
gacacagtgatttgttcaaaaaccacacaatcaagttttttctaacaaaatgaattccagggtttatttgggactttcagga

SEQ ID NO: 2507 - DNA, 28 bp, Homo sapiens
agctgaaataagatattttttactgatg

SEQ ID NO: 2508 - DNA, 503 bp, Homo sapiens
ttatcttaagtttgggccattttaaggatcacaaaatcaatattgccttcctttaagatgtatttcaagtcagctcttggctttttactttggctaagggacttagtagctgacaacttgctttgctggcctatggaaagtaagcctaaaactagaatttatcaatgctacttgtaagttaattccattacaggtaatagtggagtattgggtgtcatccattcatccagtggtgcctggtctcattaatcaccagaggtaatagtgcagaaggagttctcaagtcagcacagtcagattccttagcaaactgatacttgaaggagtagacactgtaatgtaatacagctgcctgatcaatgcaatcacagctgggctcacagctcttcaatcttttataactaaacagcatatcaagcattaggggatttatttaacaaacattttggaatgtctaatgatcttaggacatggcgaaggtaaactcaagaatcgggtatata

SEQ ID NO: 2509 - DNA, 132 bp, Homo sapiens
tcgggtgtataattcagcaggatacaatttatgcctttaaagaacttaacaattagtgtaagtgacattgcatacataagagaagacaaagggagaccacagaaggcatctaggcaacattcatgtctcaat

SEQ ID NO: 2510 - DNA, 398 bp, Homo sapiens
agttggaattataggaaggcaagactgaatcccactgtagagattaggaaagtcagttgaactggcacttgaagagtaactagaatgtcttcacataaggatttgagtaactttctctgcatatgtaagaagtgacatgagccatgtctgaggtgtcaaagaaagagtagtgtggtctggctgaagactataggagtggaggtaaggttggagacagatggccaaaggcttggatgctacactagtatttggaagttacttggagtgcaaatagaaccattcacagtattataatatagaagtgattttataaatgtcattagctggactctctagaaggaacaggaagagttaaaaataaattaaaataagagatagaagttatatagtcaaaacat

SEQ ID NO: 2511 - DNA, 69 bp, Homo sapiens
catcattaaggcatagagagagctatgtggctaccaaaccaagacaatgggaagtcttggggtgaggct

SEQ ID NO: 2512 - DNA, 263 bp, Homo sapiens
tgggtgctcaagccgtggtgggtctactgtgagaagtgacagtgaatgagacagggtgtgctaggctccgagacatctgctgaagcttcaggcaggtggcgggtgatgggaacactgaaagcaaaccttctacgtggagcagactagagatgaaggaacatgtcagccccagtgaaagtgtgagccttgggatgcaccaagaaaggattatggagatcaagcccgacagctctggagggtgattggaagcagcttagaacaaa

SEQ ID NO: 2513 - DNA, 890 bp, Homo sapiens
taccaatgtgcagctgagttggagagccagtggctagggtgtctcgaggatacatacaatcttaaagaaaagcaaactcactgtctggttgtctgggtggtatggatttggggctgactgctacagaaaaactttttttttctaagaaagtccttgttttgagatttagggttgcaactttaaccatctctggccctctctatagtcatctagtaggtgacttgtcccagcaacaccatctgtgccctctgccctaacatagctgctgcctttccactgcagagggcactcccttggcattgcctagggttggagacagaggcagctgccccttggtgcaccctcccacccaccaggagcaccgggcttctgtgcctcactgtcccaccttgccagtggactcggtgccacgcaggatgcacaggtacaccaccagccaggccaggaggaggcacagcgccggctcccactgcacacccccgttctcctggagggacggcgagatattgagggttttcctgtaccagaagtactgtgtggaggacgccttctcacactcctcatcgtagcccgtgtggttaccattcagtgggcagacagaccacggcaggggatcctgtgggaccaaagcaagtgttatccagggaggtgaaggctgaggacaaaggctgtggcaggggtgagggaggtggccctgagcggagactcttggaagagaagggtgctggtccccgaagggcaggtggctggagcccctgaaggcagactgggagttggagagtttgtcagggggcacgggtgaggcaggaaggggttggaggagggggctctactctcgttgcaattctacgggtgttccttgaggactactgaactctgtggtgggtccc

SEQ ID NO: 2514 - DNA, 139 bp, Homo sapiens
gggctcagacatgcaggacagctgtggggcctgaacctcatctcctgctagcttccaaacccaatgtacattgcaggaaatgccattcgccaccagcacttagtgagcacagaacctgagacttacgcatctcaggact

SEQ ID NO: 2515 - DNA, 518 bp, Homo sapiens
tcacttatgaacaaaggagcctcaatggtgcatgcatcatgaccatgacccgaggccaagtggtaaacagtggtgctgagatgggagggaggggaggaaaagttacttctgactgtggggtaggagaccccaaccctgctctttgaggaccagccccacattgatcagttttgcacatatctgggttctacaagcccagatttaattagacaaaaacgcatcattaatggaagcaagtctgaccaccccactgggctcaatcccatatttcacaggagacagaaccaaggcccggggtatcacctaatgggtcatggctactgtgccagtaggcagctggagcccaggtctgcacacccagacagtgctcaggactgtcctggtgaggacctccacgcccacccctgcaatacctccccaggccaccctagcctattggaatgtgtgagctggtttcttgctttgacccatatcgtgttcaaagctggccaccaacagtccttccccttcccatgtgc

SEQ ID NO: 2516 - DNA, 175 bp, Homo sapiens
gcaggtgacaggggtcctggtagacctgaagcccagttgagctgcctaggctgacatccccttgggccatttacagcctgtgtgggactgacctgagtctgttccctggactacctgctgatgccagaccgggcctgcttcccaggcttggctacacgactaaggcacccggggg

SEQ ID NO: 2517 - DNA, 328 bp, Homo sapiens
ccctgcaccccgcaccccgcaacttcatctccccagtgtgcagccaggttgaagaaggtttagcgtataggagaacttgttaaatgggccagttcccagtctgacctccctcactcacctctgaaccagcaggtgaggacaaggatccccgcatttgtgtgcataacagcccaggtgctcctgctgagaagggctggacacaaggctggaaagcctggccagggagtgagtagacaggagcacagactccggggccaggtccctgagtccaaccccaccagctatgagctactcggctcccctctgctcgggtgctcagtgtgctcag

SEQ ID NO: 2518 - DNA, 136 bp, Homo sapiens
cctctcattattatgggaccatggaggagggcttcaaagtagagggactaagggataagtccacagacctatgaaggatggaatgaatgaatatttaagtgattttcatgaatcgctggcccccatacttctgact

SEQ ID NO: 2519 - DNA, 24 bp, Homo sapiens
tttgcttttgggggatgagcaaat

SEQ ID NO: 2520 - DNA, 945 bp, Homo sapiens
cacagaggacaggaaacagtcaccaggctatagagtaagaagagttgccctgtttccactgagaaggctggggagaggcagagttgtggccagtgttcatgaaactctaggttgaaccagggaaagaaggagggactgcaactaagctcaggttacagctttcttgccagagatacgtgcaatggggcaagcttggtggagctcattgggaagccagagtggggtatgccaaatcaggattattaaagtcattcacccaagcattcctcacgcccccacagagtcaaggctatgcccaagcaccccagaggcaaacccagttcagtccatagtccatgccagccctatcttgcttgcggaccttggggacaggcatgtcccatgaaggcctggctcaggggcaaagggtaaggcattggcctggttagctcctgcctcctccactgttcccaactgggaagaagccaaggtgaaggtggttcctggaagcaggtgggggcagtggaggatggggttcctgagagtgaaacggtaggagccaggtaacagaaatgagcatgagcagtggaaaggaaaattcctcttgtcctgaatgtacaccagctctctgtgtggaattggagttcttgcttctctacaattctagccccttccacttttctacagagtgtcagctgtagttatcatcagaaatgtgtggtttaaaatgtttaggaatggccctattgtgttacagggtgacaatggtccttctaggagaacttaggggtctgcagggaaaagaagaggctcaggctggagtcagaaacctggaagcacgagtggccctgaggaaagcgggagaaggggacggggaggaagaggacaggccgttgctgtcttgctggattgagggaatccctccccaccagtcctctccacagatttcctcctaggcacactgtg

SEQ ID NO: 2521 - DNA, 491 bp, Homo sapiens
acgtggtttggggtgcatggcttcccctccacctcacaccacccaccggctccccgccccgaggctgctcaccttgccccacacccccttccccgagcgggtggccctgtttttctctccctttctcgctcctactcctgttctggcacgggccccccggctcacctggaaggagtggaagaggtaccagaaggcccaggcgttgatgacgttgtagtacatggagaggaagaaagagaccaccacgctggcgacccctgcgaggaagcagagggccgcgctgaggactgaggatggcccttccccctccgccaggcccagcgtgtgctcccaggacacacctgtggcgaccgccccggggtgggcgaggcctccctccaccaggtttgtgtggtgagtattaagcgagaccaggcacctgtgaacacttgggaagggtgatttctttttctccaacctccctcctcaccttctgggacaggaggctgatg

SEQ ID NO: 2522 - DNA, 205 bp, Homo sapiens
tcatgctgtgagaagcactgttgctgtgaagtgctaccttgtccagatgtacagttatgctccctccttggctcaccagcggttgagtcacctggtagccaggagagggggtgtgaggaggcggtggggagggggctgcccgtaattcggtcaggcctgcacaaaacccagggtgcggcctgagagcacagagaggggtgggagg

SEQ ID NO: 2523 - DNA, 123 bp, Homo sapiens
ctggttggcacaaatatctggtatctttcctatgatgcagaagatgcctctgagaagtcctctgtgattgcttattcaggcagattgtaaaactacacacttctgtgttaaaaattaatagcc

SEQ ID NO: 2524 - DNA, 348 bp, Homo sapiens
ttaatagccattcaagacaaggaggcagtctgggtttggagatgatttgtgagaacactggacacatttcttctgcatctgcaaccaggtcacatataagcttccaccctctttgctcctgaaacgtcactctgctttcctgcctgccttcctttctggggtgggaggggtgagcatcacaggctatggctacttctggtcagggttccttctgcatgcagaggcagccctgggtcataagcaatgtgcagggcaggtggaggttgtcctggaagtgcctggggctctggctcaaggtcactcaggagaagcatgagatgaaacagtcctctcctgctgtccgtgcgg

SEQ ID NO: 2525 - DNA, 60 bp, Homo sapiens
tagcagggagaagttggtgagtttccagaatggttgttagctaggacttggagttacagc

SEQ ID NO: 2526 - DNA, 485 bp, Homo sapiens
tgaggtccagagaagagaaggagggtggcatctgttccccaaggggcatgcatcctccctgtcttaccgccctgtgggtaggaaacccagctcctctcagcccacattctatgtcatccccaccaggccatttgttcaccccaggcaagagctctctcttgggccttgtgctcgccccttgatccagcagctttgctgatgggatcccacccacacccccatgctgcccgggtctctgggtgggagaggactggaggggccccacgtaccgacaccactgaggtacgggctgatggtcctccaggcgccgatgctgccctgccgcatgcgctgccccacagccagttccaggtacaagagcggcattccctccacgataagcatgatgatgtaggggaccaggaaactacctgtggatgtccagagctgagagccaggccaccaccaaaaggcttttctccacgaccactcaacctctgtgcaaa

SEQ ID NO: 2527 - DNA, 62 bp, Homo sapiens
tttcatctttttatcttcctactcagccacctgtctgttcgtccatccatctgtggatgaca

SEQ ID NO: 2528 - DNA, 143 bp, Homo sapiens
tagttgatcagggccaagacaattgtgttgttaaatatgtcagacatcatgcctggatccatgcattcagctgtccacctctatgcacttcctttgggctttgtgcacagccctgatggtgctccacatgaggtagtgtatga

SEQ ID NO: 2529 - DNA, 386 bp, Homo sapiens
ctctgggccagcccctggctggtgtggaatgggagagtagcaactctgctccctgcccttgaggttccctgctgttggtgatggtggggagccagggagtgtgaattttgtcagggtgagcctaacaaaatgtccagtgggaaaagagggcaggacttctgatcaaataaaacccagacactacaactgcaaagattaagggctgattacagagcaaactggatcctcagttgttaaggtaaacaacaaaataactatgcttacatgaacatctaatatttaccaaaaatgtctccattgtacacacgtgctgtgctgtaacccactcttctcaccctatggcattccccaggcactctcccaatcacagacctttgcatcacccc

SEQ ID NO: 2530 - DNA, 583 bp, Homo sapiens
accaggcagagcccccatggccacaccacagaaagaaaggcatgagccgcttgcatgggtggatgagtgcccacaccaccaggcttggagttcctagcttcatcctgctcatgtgggggcctagaacaaatcctgccctctcatgtccagacactgctataactcctctaggccaggctcccttcctttccttcagaaccttgtttcagcaccttgtgagttttctctcaatatcaaaggagtccaagaggtcattggtggctctcaatcatgaaatatctgacaataaagattgggttcacacactgagactttgaagccacattcaaaccctcagtggttataagataatcctgtttttacgcggggtgttaaacagtaactatgtaaggcctggcaaggtccagggacgactgtctctctgacagggtctgactgcccagtgcccatgggtagggtggaaatctaaaacctgatgccaagtgggaacatgggggctgtttggccctaggcattaatcatttctgtcactcctgacccaacctatcaaataaacacataatctgggtgaatttgctctgca

SEQ ID NO: 2531 - DNA, 82 bp, Homo sapiens
tggaagaaaagattgagaaattggatttcgttacttctttgtgaaagacactgttaagagaataaaaacaaaaactatagac

SEQ ID NO: 2532 - DNA, 32 bp, Homo sapiens
gtagtaatacaactacatgccttaaaggcatg

SEQ ID NO: 2533 - DNA, 251 bp, Homo sapiens
taagtcctggagttttcaagtggtttgttatgaataaataggtaactgaggcacacattgagccctgtggtaatgtctctgccactgtgagtccatattaccccagatgagtgggacgcttacagtcacagaattattggaagatgtagactcagctcagcctggtgaatccttactcatcaccacctccctggcacccactgtcacatctccactgcaccgccctccaggcaggtctttgtgattccacc

SEQ ID NO: 2534 - DNA, 404 bp, Homo sapiens
tgtggaaggggaaaaatatggttggatgagcatctagtgagttgctatgacagaagaaaattcactgaggaagttattttcttttggaaataaaaagatacaaaataaaaacaaaacagcaacgttcatctttgtaaagtgtatctttagttttgaaattataaggtgaatgtacctttggttaggttaggcaacttaacacagcttattttgcttaatggatgttctagggataattattgtcgtttaaatatgtgaaataaagaacacttcctttgaattaccttttaaggaagtcagtgtttaaactgcaaaggcttcttaatagttaatagtagtgagagttgattttctgtagcagtagactctgtttgcaacagattgtatgagagtgccctttgggg

SEQ ID NO: 2535 - DNA, 1181 bp, Homo sapiens
ctcatgtgtttaatgtggaaaacacctcctaggtttactgataaaggtattcttagcaccatggagattttgtgatttttcacagttgatgatgattatttctaacggtagagtaagtaatgactttaaaaattcacactataagcttgaaaattcctagtgcttagttttattgtacataattttgcttactgtatcattaaatctatttaggtaatgaggcaaaacattttctgaagcttggtgggaaagtaaaatactttaagaataatgcatgactgaatatttcgtacatttcttatatgtttatttaattgaaacgtactcttggatcagagatagaccacataaatgtcaaaaagagattttaacccaggtattgcaagtgtaaatcatatttatcatcaggagaggtgaggagaatgtttaaaccttcctccattcctactttcagtttttccatagaaaaaagtatgaataccaaatttgtctgtattttgataactgttgattgaaaactattatgagtaggctacctggttagaaaaatacagagttgagtcaaacttggcccttgtctttcaaaaagcttacacataggggtagaaattatgactaagtgtcataagctgctgtgcaaggtagaataatacggtgagtgtgataaggaaaatgaaaataaaatagaccaacagttaagatgaaggaaaagcacgggaaagataaaggagaaacaggaaatggaagtaacataatcaggtaaattatgccaactatctttgctcagaacaaggggattgcgttcataggtaaaggaaatgagagcgaaaccggcaaatgtttgcaatggacattgaaacaaaacttaagacatgttagtatggcacttctgaatttaaggagatagtgggctaggcagtgaggtcaaggtttaaaagcagagcatttaattggcaaagcatatgtggaatgaaaaagtacagtctttgactctcccattcagacctgattattggcaacaccagaatcgcagtttgcatggaagctggttatggtttaaagaggtctggaggttgtaaaaatagactatgacactcagatgaggctcctgcgtgtattttatatttcactatccctattcttgtcctgacatctaaagcttccccttctaaaagaattgc

SEQ ID NO: 2536 - DNA, 701 bp, Homo sapiens
gtgcaggtaagaaactaaaacaacgtaagtatgataatgatctgacatgactattcatttcgctgctctcctactttcatgtaagggtcaatttttccctccttttttgtattcctccttccttccttcctgtttaaaaattttattttagaattacagaagaatgattgtacataaaagctaggctacaggatttctctaccttacattctattatagcaaagaaagactgaatacaaaacaaagctcctagaaatcatactcaggttttaggaggagttgaatacagaaggaatgttcagagacatgtaaaagagaaagcgttccaaacccagcaaggacaaagtagtagaactcaaggtcagggaatgtaatgagacacagcataaaagaagcactgtcagacgctttggagaccttgatgtccatttgggtggaatcagggattgatgcttttcagtaagaagagcattaaaactttgaaatgctagtttctgtgatgtggaagggtagtgatttgtttgaagagagttctgtgtttgaggaaagatatactccagaaaagtggagtggaatagagaactgtggagaataatatttgaaaaatatgcgcttttttcagagcactcaactaatcattgaatgaaacacaatttcctttaatacgtgaaaaaaccttcagggtagatattattcatatt

SEQ ID NO: 2537 - DNA, 303 bp, Homo sapiens
aattattcttgtcatttctatttacgaaatacagaacttgaagctcaagaaaattttatgattctagattatgacataaataaatattagaatcagtaccataatttaaacctgtttgtgtataatactgaagatggatatattctttccaatttatcacatttatttttcacttcaaagactttctcaaagcatttttttctttgaatctacatactatagagatattattcagagaaacaatgtgtgattttacttataattactaaagaaattctcataggaacctgggttttctgtgac

SEQ ID NO: 2538 - DNA, 2331 bp, Homo sapiens
tgtgtgactttttaaatgtttaaaagttattcagtgaataaccttatggagaaatcgtgatcctgtttatggtgctggtaatatttgttatttttttagctggtgtaatgaaactcacaattctgtgtcattttctctcaagagatatccaagaaaaggaaaggttaacatacattttttcagtattttcagagaaattgtctcacgtataggacatgttgaatttaacatcttgcatagcatctgccctttcatttttagctacgaaaagctaaatgaaatggctgttagtatacaaacagcattaggagagtgacttgtttcttatgtagttcttctaataattggaagaaatcccaactctggcagagtggaagtatttggaggattctcgttttttcttttcttgttgttcagctgaaatgttttgatcccacttaacaaggattcagtcttgcgttgttctttaagtaccaaggagatatatgagattgttttgaagtagatgatttattttctaattatcataggtagttaacagatgcatgaagaaagaaatgtttccacttgcctattatttactagaaaattaatctaaaacctatcttttcacactataatattcatccacaatcatgcattttaagtgcttcttgttctttcccaaatatatcaagaaccagtttctccattatttcagagattccaagcctagtgatttttaattaagattgcattttgcaagtccagtcttcgtaaatgtaaaacttacagaatatattttatggcacccactgaaagtatgaatataacaaaaaccctttctctattaaaatctttgtggaaaatgctggaagtttccaggacatacagactaaaaaagtaacaatgcttaacatataagactcaaacgtttttagacaaccacttgtgggtatacatgttttttgaatttcacatagctataattactagtatgtgtcaaacaatttaccacgcactgttatatgccatgtcttacactgccattactgagaaattccaaataacattgaggtcacattgactttggtacaaccaaaatatttgccagcattagacttttatcaataactcattaaccttctaacattttctccctttatacccactaatctatgacatttttcttgagttccttccaattttagacattttatttgaattatctttctaagtacagtgtcatttgcctctattttctgtgccacaagttgtacctttgatgtttttaaatttaaactttgcattttgatgtggaagtagcaaggattcccgaggctatgatctgatcggcaacagccaggctagcagcaagggaagttgagataacaacagtgggcataccgaaatgagcatactgttacaacacgtgttcgtagttttatgaacatattatggagctgacagatgctatgataaatttgtatgcagatattgtctgcagcataatttttatgtattccctttaaagctgaaagtgtatatgtctgtgagcaaatatgtattagcatacatgctttcctgcctgcctagttttctttctttgggacaaaacattctgccaccttggcttcccacataattaaaagtttctacacattattgatatttgtaacacctcttatttttgccatagaaatatgttgcactatttggctttcctttggggggaaaaaacctgcacacacacatagacacacatacacacctgtggactcaagttttaagagcatggcctaatggtgcatgactaccacattaaaagaaatgcattcagtgatgtcacaaagctgattgcctcagttgatctataatttggttcattaataaaagtcagcttattggtagtattctcgcaaaggcttcaaattattgcattttaagtaaaaatgggagtaagatgctaacatctatttctaaactttttaaaaaactaatctaatgcaattataacactagaatcctctgctgaagtcccacaaactttcgttcatgatttgccataaggaaacccagccccagctttgctgactagtaagataaatttatctttaccagacccaactctttctgccattctgctaagtcttggtggagtagctaaattaatccccccaaggactctttaaattgccagctaagctttcttggaacctcatcacaaataggcattatgttctttgtgagaaaaatttcgctctgcatttgatcagacaccttagttgtttgcttgatacagaacccttcactattctttataatattctacattattcagtttaaaactcc

SEQ ID NO: 2539 - DNA, 261 bp, Homo sapiens
ttgacattaaaatggattattaaaagtgattatgtctctgactgttggttcccttgaaattactgtgtgtaacatttccatgtgaactaacctgctttgtatcaatcctgcttatcctttattggtattttatcaacttgatttaatttaactgtagaaatgcttcagtttcctgtggaaattaaattagccaattgaattttagctgctgcaactttttgtatttagatgacttattaatgaccatggtcattttgtacc

SEQ ID NO: 2540 - DNA, 329 bp, Homo sapiens
caagagaaatactctagaaagtattcttaggtaagccaaattatttattttgtatggtactgactttgagtagccttaaataatgtccgctgacatagctatagtgatattaggatatataaaaagttatatgatatgcagtgttatacacaggaatattcctagaataagaggatttaagaatgttcttttatttaaaatccctgggtttttttgtttcaaagttcctgcagtacaccacactcaagcttaattatttaaatgtgaaaatcttccttaaaacagaatagaggaagttaagtgtttcatttcgaaattacccaaattgt

SEQ ID NO: 2541 - DNA, 953 bp, Homo sapiens
gcttcaaaaaaaaaaaaaaatacccaaactttaggattaatattaaaggtattgaggtaacattttaaatttaaccttacatgagctacagttcttcatgatggataatgcatgagatgaaaaacatcgaaaaacatgctaatcttccaaaaagaagctcattctagaataatttgaggctttgggagataatatatttatgaaaaaaatagaaaaacaaattattgtgtcataaaagcgattatcccagtaatgaggagcaaccccaaactggttgtgtgacattgatatattttgatgattgactatgcccagaacagctgattcagcagggcagaagaaatgtagttttggcaaaggtggcaagaaatttcagaaacaattacaaaattttatctctaccacctgaagtgtagcaaattttaaatatttctttgattttgaaaggccttgttaatcatttctttgattttgaaatgccttgttaattctttttactgctaatcatttgtgctctctgaccagcataaaacagctatagaacattaatgcatcacaagcaactgtaaccaaattaaaggcctataagtccatttttttggtgttggagattctgtgcctatttcacctaatgtacttttaactaaccatgaactaaaaatagtagcttgcttctgaagatggtgggtctcaaacatcaaaacagagtcagaaatgtcctaggtgcccagacatctagaggggcgctcagcagatgggagtcaatggagtctagaacaaagtgttggattagagtgggttctgagtggagcatgaaaaccagatatttgcaggcacagctgaaggctttgagggcacattactccagcattttcctgggaaatagcggtgctattataacggtttagcactgacaagtcttggctcatagctctagcaaggaagtttataga

SEQ ID NO: 2542 - DNA, 467 bp, Homo sapiens
actccattcatattataccctagatggagtggtccagaattctaataagtgagtagaataccagatgaagaatccgggcaacatttggaaactccaggcaggcagataggcctgatactgtagatctggtatgaagcccttagctctgggttggggttcaggcataataaagttcctaaggatcatacactagtctaggcctcagtcttagaatggaccttggcaactctgtgggttctgagcataaagacagagaaagaaagactaatgcagaagtagtttagaaaacaaaacaaacccactagactaggctgggttctaacaagtcttgaagaaaagctcagttttctagtcatgaatgaattagctactcaaaagacccaatgcagggctacaaattgtgaatttgtagctctgcagtcattagtacttctaactatgactgacaggacagcctttgtgtgggt

SEQ ID NO: 2543 - DNA, 1053 bp, Homo sapiens
tttgtgtgtgtgcatgtgtgtgtgcatgtgtgtgtgcatgtgtgtatgggagtggtgttcagcagcaagactgccagttatattcatttgtcctataagacctacccttgctgcatcatctcagcaatccttccttgtatcctcaaattgctttgtcttctttagggccagctatttagtactaggatgttattcttcctcacaaataatggagaaagacatgtagttatttgctcaattaccaataataacccaaacttttgcatttaggaatgctatctgaagactagccagggttagctatagacaaagagggaaagaaaaagaaaaagaagttgaagtttgttctccaaattgtgtcttcaggataagagccaagttacacttttatttacatataattttaatcatgaacagcataatttcatcttattttaaattattggtgctaagaaaaaaacaagtagaaaaaaagactgaaagttttagtgaatttcaattacttatggcttagcagcagtaactgaagagctaatttgtttagtaatgaactttatctgcaaaagaaaagacaagacagctactgaattcaacaacaatgacttactctccagtttcaagcaaaaaaagacaatagaacttgtctataccattcttcagattggtgaacattaatcatgttttgcttttttaaaaaactacaagacagttgtataggggcaaagaacatgttgatgatcataattttgtttattgcagaatgaatatttgatggtttctgagcaaataagaggtgtagggcattttcccaagaaagctctcttgaagatactgaggcagaaaatgcatcatcccagatttcaaccagtttcctttctagtgatgtaggtaagatctgcacaaaagtacgtgtaatataaagacaaatggggttatttgaagaagagttacaagtggtggtaatatgaggaggatggaaagatcatatttgatgtaggcctggaagaggaaagatggttaagattttatcaagcacatataaagtgattaaac

SEQ ID NO: 2544 - DNA, 500 bp, Homo sapiens
ggctgtggacacctggagagggtttattccttctgaagacaacagcacagacatctctgcaaacaccttttctttagagttgtcagaatagagagatttaaaagggagaggcaatgccatattaatcatgtttctacaacaagacataacaccatagcagacacatcatcatttctggggtcccaggaagaaccaagggttttcaaggctccccacagcaatgctaagctatataatctcctcagtttctttctcctcctactcctcaaacatatattatgcccagacctatgccatgtgctcagatatcccaaaggatatttcttgcttgctcatctatctcttcacagaggacttactctaatctaaaagagagacagaagacacaagaaaattgaaaacactgcttagtctaattcatcaaacaaattactataggggtagttctggtcttgaattgccacctgagatatgacatatacgtgtgttgtggggagggg

SEQ ID NO: 2545 - DNA, 743 bp, Homo sapiens
aaacatctctttgagggtttttgttcacactcacattgtgtcaatcaaggcttttacttctagatttctctctctggaggtctgggaccgccactagagaggcatacatacattctggactccaaattcatcctcacaattcttatatacctctgacttttctcttatgtttgacaatgcctttaatttttcagtacttagttcttagctcacttttgctttatttcacaaggagggtgaacgcagtcaccacttgtgcagtaaaggaacaaagattagaagtttataaaaatttcggaggaggattttgaggtcatggagctatcttcttggaagcagggaagtcagtcacagacatcgatggaaaaaaatattagaagcaaaaggcctggggtgtcacttcaggaaagtaaccacttccaatctgaaaactgttcaatcccaatcccttaccacctgcagatacagcactgctctataggaaacacttaaaacattaaaaaactagccaactgtgaaataaactcttttaatactctttacaaaaagccgacttaggacaattcaaattcttagcagcagtagaatttgctgtaagtttaagatatatcactaatttaggagctattactgaaataacaatgtttgctttttaacctgaaagtgaaaccctactaatgagcataatcgtaaaatagctttataaaagcaaactcaaagtttaaaaagcacatttaagctaa

SEQ ID NO: 2546 - DNA, 577 bp, Homo sapiens
ttatgctaaatttttatccaaaataaaggcttattttgaataattcaaaaggaaaacaatttatcaagaaacaaaagtatgtaacagataaatgctaattcttacttttccccctaacagaaaagcataagcataaacatttcctatagcagtattaacacatacctgttttaggatgtattgaaaagaatccttgtggatttccacttgtaattttgtacatgagcttgtcattagagctcgaatctggatcaaatgcctcgatctggaccacagatacatctttaggagaattttccatgatttctgggtaataaacaggctctgatgtctgtggtgcattgtcattgacatcctcaacctctatgtagatctctatgaacgatgaaagaggcacgacaccctgatcggttgcaaagactgttagccaataatgggaggtcgattcacggtccagtcgatctgacgtctctatgacacctacagagaaaaaagaaaagcgtaaagcagcacatcaacgaccaaaactgccagcttcagaaagtgtcaacaactacggcttactgagagctttata

SEQ ID NO: 2547 - DNA, 181 bp, Homo sapiens
ttaaaaatattatctcactgaagtctcaaaataggtgagcactaagagatcatctaatggcccaacacttcatttttccataggtaaagtttatagttggttgagagacgtgctgactttcctggaggctactcaggaagacagggacaacaccagagccatggcccagatctgagacccc

SEQ ID NO: 2548 - DNA, 215 bp, Homo sapiens
tggcggccactgtctaaggaaaaaggcaggagcagcatcctccagaaagctcggtctgcacacacaccccttctcacagtggctaaggaaagaaactgcaaccttcaaagtccacaataaggggctgctcagatctcctgagtgttgaggtccttttatttctttcaatcgcctcaaacaaatgggaagacaaccagcatgctataaaaatataa

SEQ ID NO: 2549 - DNA, 816 bp, Homo sapiens
acaataacgtattaaatacacaagtgaaatatctaagtatcttaatcagggttggtatagaaaagtcctcaactgggacccaaactaggatacatttcttagtaagtcaactagcaagagatgaaattatatgattacaaagaagagggttagagtatctgtaatgttttggtccagccactgaaaccagtcaaaacttaacttcaagccaggatttacctcctctggggataagaagtagaaatatccatttctctttggcaagtcccacctttttattcaatggtgcaatctcgccctttgtctaccaaaaacatatcactgcactttttctcatggattgatcactcgggactaaagatactttcagtgttcttctacaccatggtacaggctggactctggaaatgctgaagctctagaatcactgaagtttcccgttaaacgcaaactactgtgagaaaaataaccaattaccaattttacctatgctcagcaatgaaacatttggttgagaaaaatacactgttgcaattcgtaattttgatcacacgaaattaaatattaacttattcgaggttaatatcagaaaaactcattttttgaatgaatgataattatatctaatactcccaaaaggactcacaacttgaaaatagaaaacttagctaaataaaatgtgaaattatcataaaatgaatctttattgccattcagaagcattacaatgatttgttattgcttcattatttcatactgaaccttcagaaagggggtataatactgcttctagaaacatggaagaaacctcagaac

SEQ ID NO: 2550 - DNA, 511 bp, Homo sapiens
agtaaaaaaaaaaaaatgaaataaaataaaataaacctcagaaccaaataaaaatgagctaactggttcctccgtacagcagacaactgaagatgaactcaaacatgcttccctgttctctaacccaagcataatgcacacacactcaactggtctgctaaattagcaaaattatatctgtctgtaggctcaaataataacctttcccagttcctctgattcatcacatctatccacagatacaaagacgtcaggggataacagaatgttctctccgggaggattacacattaacaaaatgtacacaactcctcctgtgtgctgctacttcattaaaatgcaataaaattcacttgacaggtgaagtattattagaaaatctcaagaagacaggtacgtggtgcttttatctacctcttttgagttctaatcctccaacaattcatgcttccatctactgttttaaaatgtgcccctctaaatgtgactagaggcatttacaaacagtgat

SEQ ID NO: 2551 - DNA, 774 bp, Homo sapiens
taccacaaatctcatcttcagcgccagcaatatccttgtcagtcctacggctgttatgacaaaagagtaaacaaaacttaatgtggtaatttgggaaagatgagtcaaacttcctatttcatccacctgttctacatgtcagtattcagcaggaatgtattaaatgttcactcatacacaatagctttctctaatctcaagggaaaaaagaattatgaaatggaagtatatcaccctcacatctgaggtttgcaattacagatagaaacagctatgatttttccgtcgtgccttatttctagttcgggccgtaagcgtccagactgcagtgtgcaattctgagatggcatctgctggtccccaccgacccatcagctgtacaaccagggggtgggggacagtcatgtccatcaggaggggattgtcggcctccccggtaatctacggatattactaaaggttaagactgaggcaacaaagcgactctattcaaatatcggagattgtgtaattcgcaattaaaatagtaagtatgaatgagtgagatgctggatgttcctatttcatgaattcatgactgtgtacttttataatgcctatcgtgattgctgagataagcttctgcttcgatgcattttaattattacctctttgtaagataaaaaatcactgaatacaacttacggagaactataaagtaaatttcaactgccaaagggagaggagggcacaccgaagaatcttatcttctaaccaaaatcctcagatccctca

SEQ ID NO: 2552 - DNA, 1181 bp, Homo sapiens
agcggtgggctgttgccactatcaatcaacagcaacactgtcggacaccaaaggtgctggggacctggtggggctataaccatgaggaaaggccacaaggagtttcccagtgtggaaggaagggtcttcctcatgcatgcaggacaacagacgggagacgatctgaggattccgctcagagttttggggttcagtacctaggcgctattataggcactgcacaaagtgggtggaaggaagccttaagcgtgccaagttattttgttttccgctttttaatctgtcagcccagttgcatgatacactcctcaagaaccctgggcagaaacttccaaagtggacctatggcactagcccgagatctctaggtcaaaaccccgaagcttcccatcttgaatcagaggcaagacgaaggtccaggatggctgagtgagagtctagataatgtgcaaagaaagaccaggggtagagctagccttcgccatctcaaaatcaagcattagactgggaacgccttcaaaaccctccagtgcaactcccttgttcttaaagaacgttgaaatgatttgtccaactccaagaagctaaacaggtgtagttcagaatccagagtgaaggacttccttaatcaggggttcatcacgatccaaaccattctttaagggagtcctggtttctgcagggagtgacacaccagctgtctccaagtatgaccgaagctgcctttactcattaagtcattagcagttcttgttcctacacttcatcatgctttcaccagtccttcctaaagccacgactggcatttacagattacagattgatttcttctgtaactttagcagttacctcaattccatagagagaaacaaattttcacatttccattgggaagacttctaattagtgcctttaacacagagaaaaacaaaaataaaactaaagacatccagtcatcactggatgtgaatcaaactgtggtcactctcaaacctctatccctgtctatttctctttatccatgaatgtctacctatcaactttcaataagtacttttttatatagtgggttataaactcaccctggagacaaaaggaaccaacaaaaactatagtttttacaggtatctttctatttacacatattcacgacctcacctttttgggcacctatgtatatc

SEQ ID NO: 2553 - DNA, 742 bp, Homo sapiens
tttcagtctggtttcaatgctttttgcaggcacagccgcggcttctcaaatttcagagcttttaacccaaagaaataagaggccaagcatccgctgctgaagccgtccttgagtgccctgcatgcatcatccttaaagcctcaaaataatttgagagtctcatgtggtccaaagcaaacacagtcaggattttctctatttatcttaatttctccaccagctctcagatctgatggtcattaacatgcacatttaggataatctggagggcatttcagactgcagacaggctggccccaggttttgcctgggagggcggtctgaggccagcaggaatactgtaccggggctcaggccgtcacccgcagccagcatggagaacgctgtcctgacacaagtcactgcatcttctcatgggcatgttaaaaaaagaaaaaggaaaagaaagaaatggaattaacatgttttcccattaagaagttatgaactgctgtagttccgacagtgtttgctttatacagttttattacccattccatatttcttgaattgtatcttgaaatctcagcatcaactctctattacaatctagctttaaaaataaacacccacttgtagatatgtatccatatgaatctgtgcctgtgtacgttcattcttaataattgatttttgacatatcacatcagttatttggggaaaacgtcatgtggaaatcaaagtgcatttggtctctggcaag

SEQ ID NO: 2554 - DNA, 1043 bp, Homo sapiens
cttctcaactagtttccatatctttagcttttgaaaaaagaggtaataactgaaaacaaaataatacagaaacctcagaggattaaaatagagtggagacagcagacatgcacaatgaccaaaaatgtttaactcggtagaaggtagttcaccaacccaaagcaaattcctggcagctcctatcactggtttatgtaacatggtgaaaactgttaaatgtctttcagaggaagactcatgtaggtgattacaggcaggaacacaaaagacatgttgcatgttctttttcttttgaagcaggtaatgttgtgcaacaagcagcataatatcaaagttctgagcttctttttttgaactaccccctttgtcttttctcttagattataggccagagaaaccccaaaacgtgaaaatgtggccttcattcgagttcaactgtggcctctgctcatgcttggaacgtgaccaaagagatggttttctatttttagtttgagaagtcctttacattttctctttttagtatagacacagtcaaagatttcattcatcatttatattctaatgtttggcttgtgtcagccattctgtaaggtacaagttgaccaaccttctcttggtgaacaggtgaaatttgggtggtccacggtaggcccagtggattggtccattgataaactcagtaagtggtctttggtctttacgtctctttgtgatggaaacccatcgtcagtgatgccaacactacctgcgttagtgtttacttggcccccccgccagctcttcctagggagtaacaggctttggagcagctctttccagagctgtggctctacttggctatttccatggtcagagaaggcagaggggtggagacagagggtcgggtagcaaggagaggactggagaccaggacccagcaatctctgaaggcttcccggggctgctcaccaggttgtgagagtcaggcggggtttcagtggaagccccatcttgagatctgctcttctgtcccagaatttgggggaaagaattgtgtattt

SEQ ID NO: 2555 - DNA, 495 bp, Homo sapiens
gaattgtgtatttgtgcgtttcttttcctgcatgaatttaaaaaagttagaataaaaattaaatctttaaaaaggtcagagatcccctccctggcctttgaaaaggcacctcatcatatatgaaggaaagaggcctcacatcaggattgaagaaattcactatctctagagcatcaggaatgatctagaaaccaacctcagtctcagatcactgtctgccaggaggaaaagcccagctgctcagcacctcagtggccagtcctgaaccaaacccttgttgagggctgccctctgcttacagaaagaagtccgcactgtagactcctcctgctagctcctcccaacacaacctcatttaaatccaagggtacaggagccccataggacatcaagattaatttatgacatagcagtcccagcctctcttaactgttcttccagctctgggcctgagttaatttgtattttattttgtttttaaaatttcttcctaag

SEQ ID NO: 2556 - DNA, 872 bp, Homo sapiens
tatattttacacatacatgtaaatgcatttatacttaacattatcacataaacatcttctatgttattacaaatattcttaaatgtcctggaccatgagcttcacttcactcctgtctaaccctattttacttagtgttttctggcattaagaatgtgagtcctttggcatctcccagccccccttctttgcccagccaccccagtccaggggcccacatgcagtagggagccccaggaccattctttccagaagttcagggaggcccagagcttgggtttagctccagggtaggacagacctttcccaccagccaggctggatggggaacaattgccaactctatagcaccagccaacctacttcatctctgcacgctagttttcattttacttcttaggccttaacaagaaatagccacttattttaaataaagaaaatgtcttccacaaaatcaagttgtgtgtctcgtccctgacgttggcaaacataacttaggcttgaagcaggaaacagagtttatggtgtgaatagttctcaagcatgcagcgtctgtgcatgccctgaatgtgcacccatttcctctgcctccttctccttcacccatcaggaactgcagcaagcaagcagtcacatcacacctcccaaccacatgcaaagaaccaaaaaagcagctgccagaaaagcttcgggaaattttcaaattagatcttcaactgcagtaagagtcatatttaagtaaaagcacatcagcccggctgagctctgtgccaccactgcaccccacacccctcctgctttctcccccaaacaatttccagctgacgtttagtgaacagaaaatgttttatgagcttaagagaacacagaga

SEQ ID NO: 2557 - DNA, 1098 bp, Homo sapiens
cattgaggtgtttggaccacaatattctggaaaacctttcctctggcattatgctctatacctctatctttttaggaccacacatgccattcaaagaaagggctgaagcatggagttcagaaacaagtgctgggctgtgcagacagcctgggaatccacaggcccacccggcttcagggctctcaggagcaacttcaggggcctacacaattcgtcttctgaggttgtctccaaactcacaggaagcaagagggtttctattccagctcccctcaggtagcaacaggcaaggcacgcaaaagtgtgtgatgggaggcaggcagttattgcagaaatgggataggtccccatgacagaagggaagaaaccaacagaggattcttcccgggagccccaggttcagcaagtcacacctctcccatggggcaaggcaaggcagatggtcgtgggcctcctgcagcacagacatccttctgtccactcaggagtggagtccaggccctcaggcaactgaggctagagcactgaatcaggggactgaacaagaccatgcctgagttgcagatacggccacctggcaccttgcaaacacacgcaagtgacaggtccccttgcagagcagagcactcaactgctctgcccaggacccctgggaaacagctcctcagtctgccggtgaggtggccacccaccatctcaaactccacaagggagcactctatttgggggcaaaccacacataattaacccaaatggacctgccatggtggtcgtccccccacccccaccccgagctggcagtccccgtcagcagatcccaatctttgtttcaataaggggcacccatttggttggctgtaaaaccctgtgtgggttcttttgcaacaatgttaagattgcacagaaaccggcgttctcctgtcctctgagtgctgtcctcacgctgctgtcctcacctgggcctgggaatacctgcacacattgctgagtcatgtgtacaggataacgagagctcctcccctttgtgcagacacaaggaaagaggctgcaccccattcatttgaacgcctggcacgttcttcatcaactccatggaaa

SEQ ID NO: 2558 - DNA, 450 bp, Homo sapiens
gtgaaccaccatgcccggcctggaaattcttaagtgcttagagtgaaatgcattttgtcagaagcctatgaggttttaaaactccgtatgtctttttaatgactagctgaattctcaccgattcgtgaagcccgcagagtatgatgtacatgttctaacaactactagggccaagcattttggaaaaaaaaaaaaaaaacatggacagcttactttcaccaaatgttaaaagaaggcataaaatgaaatgacatttattttacaatggcggaagtcctcaggaaatgaaatgtgctaatacattttagctcgtatgtatccttctgatcacacccatgtccaaacaagtggttttcaagcttaaatgggaagaaacaatctatgaatattaaagaaaatatgtattctttgtacactattaaagcaggcttaaaggacagatgaacctcc

SEQ ID NO: 2559 - DNA, 228 bp, Homo sapiens
gactgacgaacctccgcagtgattctggtcactccaggagcatgttgtccatttgccagtggagagggccttgccagggtggagcaaccatattggagtcacgctggaaccccacagcccctaacacggcccctaacaggaggcttctgaatgccacagtcctccctctcagtgcagtgtagaggccaccaaattcagatcctgggggtgtcggggaaggcagtcttc

SEQ ID NO: 2560 - DNA, 267 bp, Homo sapiens
gagagttaccaatgcacaccacgggactggctcatgcaagattttccatctcttcggaatgcacagagtgtgtcttgttggagagagaatcggaagagactaaaaaaggtttccccaaactgaatgtgctctcacatgactggagctccgtgtctttgcgtgtgggaccgtttcagttagaggaggtttatgcctttgcggtgatgttttcccactgtaatacaacgtcccagtgtctacgacacatgctgcctttctgaggtccac

SEQ ID NO: 2561 - DNA, 234 bp, Homo sapiens
cacatttgtgtcatcttgggaccctcagggttgcctgttcctgttcacggtgcctgaattgatggctgatgggaagtcccacttctccttctggacctacacaacagaccttggcctacgtcagtcttatcaaccattgcaaataaaacaagcctccatcccctatttacatagtggaccaggatgcttggtctatgtcaatcttatcaaccaatgcaaaccaaacaagcctgc

SEQ ID NO: 2562 - DNA, 598 bp, Homo sapiens
tcttggtactttggttagcaatggggattgtagctatcttgtactttggttagcaatggggattgtagctaaagtgccactttcatcactacgacgctgattgtcttcagttgcccaaggattaaaatgtaaccatgatgaatttcgagtcaggaaacacgtcacagtgggattctatttccctggattcccttaaagacacggacacatactcactcagggcactgatgaggctactaaaaggaataaaagacggtatcactatggggcccttgaggaaacagttctgcgaatcctccacgcctcattctgtcacgggagagagtctctgcacttctattttcagcaggccaacatttctctgtgttgcttgtgatgatcttatgaggggcctggagaaatatgtacacatagattttagcatgagtcttgcagcactgcgcttagcagagtgtcttctcttacagagcatccctgcgcttggagttggggcgtggaggactgtccacttcacctgaccccggaatgtggcccagagctactgacaagggccgtcctttgtgaaacagaggactatattgtgctcatctccagctac

SEQ ID NO: 2563 - DNA, 118 bp, Homo sapiens
ccccaacctcaccaagcatagctcagggacctctgtgtgttttctctctgtatgttttttgtgcatatgtgtgagtgtgttttctgtgtgtgtgttttcctctctctctctctctctc

SEQ ID NO: 2564 - DNA, 725 bp, Homo sapiens
gtgtgtgtgtgtgtgtgagtgtctccaacctcaccaagcatagctcaggaacctcagttgtcccttgaaaacaccgtgctgccaggtactagacacaaatgtgactttaaacgtgacctttacgctcaagcatcttgtagtctagatgaggaagagagaggaatggaacaccacatcctcttcagagccaggtgctatgggaaagttcctggctgtctttgcagaccacacaccaagacagctattgtgatcaccactttatagtgaccagaatgtgttcagcaaggcagcctgcccacagcctggagaacttacaattttttccaggcgtgatcaaaagcaaccaaacaaacaaatgttttcactccataaactgatatgtgccagggagacttgtcctgctgtttatggaatgtgggggcacttagagtgggggtgaaggcttggctcagaggaaccagcagctgtgttatcagagacaaagggaagtgacaacacagtaatttacaatgatccctgcccaaattatctcagcactccgactaagagcagtgttcctgggcaaggagaacacacaatttctcacctgctgaagaatgtggaagccacaggcagtgtggctggaagttcccatcgtccctccatgagtgacttcataaagcttccatcaggcacctgggcctggctgccctcctgctcggattattctaaatataaacaaacga

SEQ ID NO: 2565 - DNA, 539 bp, Homo sapiens; identical to SEQ ID NO: 2130

SEQ ID NO: 2566 - DNA, 37 bp, Homo sapiens; identical to SEQ ID NO: 2131

SEQ ID NO: 2567 - DNA, 98 bp, Homo sapiens; identical to SEQ ID NO: 2132

SEQ ID NO: 2568 - DNA, 182 bp, Homo sapiens; identical to SEQ ID NO: 2133

SEQ ID NO: 2569 - DNA, 249 bp, Homo sapiens; identical to SEQ ID NO: 2134

SEQ ID NO: 2570 - DNA, 185 bp, Homo sapiens; identical to SEQ ID NO: 2135

SEQ ID NO: 2571 - DNA, 934 bp, Homo sapiens; identical to SEQ ID NO: 2136

SEQ ID NO: 2572 - DNA, 91 bp, Homo sapiens; identical to SEQ ID NO: 2137

SEQ ID NO: 2573 - DNA, 112 bp, Homo sapiens; identical to SEQ ID NO: 2138

SEQ ID NO: 2574 - DNA, 238 bp, Homo sapiens; identical to SEQ ID NO: 2139

SEQ ID NO: 2575 - DNA, 481 bp, Homo sapiens; identical to SEQ ID NO: 2140

SEQ ID NO: 2576 - DNA, 593 bp, Homo sapiens; identical to SEQ ID NO: 2141

SEQ ID NO: 2577 - DNA, 105 bp, Homo sapiens; identical to SEQ ID NO: 2142

SEQ ID NO: 2578 - DNA, 144 bp, Homo sapiens; identical to SEQ ID NO: 2143

SEQ ID NO: 2579 - DNA, 1065 bp, Homo sapiens; identical to SEQ ID NO: 2144

SEQ ID NO: 2580 - DNA, 293 bp, Homo sapiens; identical to SEQ ID NO: 2145

SEQ ID NO: 2581 - DNA, 160 bp, Homo sapiens; identical to SEQ ID NO: 2146

SEQ ID NO: 2582 - DNA, 852 bp, Homo sapiens
tggttcctgtaccctggcgttgtccatctgtagggatctgtggggacaggagacaagttcgtggtgagatgcctcccctacagcccacacaccccaaggactcacctccagatacaggggagtgagggaaacggttcagatggatgtaggtgtgagacatgctgggaacagcagggacgtctgtaaggagggaaagcagagtccgcagggcagaaacagagaggctgagccaggctcagaggactcccagcagaggcagtcacgcaggccagcaggggtggctctggaacccccgagcaagttgtggcagcaaagaattcgggatctgaggggtttcagttgtaggtctgaggtctgtactgacaaggggcaggatgccagctcagcagtagtggggaggtgaagacctcacaggggataggggatagggatgggacaaaagagggaggtctctcagatacaagacccatttacagagtctcggctcatccaaagaatatgaggggagggggctttgtgctcacagatgattgggttaggggaaagatgattaatcacaggctgtggacgcattttcgaggcaggagccaagccttatggcaagataacgaaggggacggcaagggctgctctgtgggggtgcacgggctgggcccgcagcacaccacctgttcactaggtctgggcagcaattagacctgcacccagcagggcccacaaggtcagaacagggactgtgaagatcaaacggaagcgcaggagggtgttcgagccttcgggcagggcttgtgcttcccccaaaatcagtgcaggtttgccggtggctttcaaccagaaagcactaaggaacgc

SEQ ID NO: 2583 - DNA, 493 bp, Homo sapiens
caggctgaggcagggatgggaggtcggggtgaacttgggagtgtttgaaactgaaggaaataaagtatggccagggaaccgccttccagcattccagcgggtccctctcagggcagcacttcctggccctcaggctgtgggtggccccaagttagacgtttggctcagcctgctctagacagcgctggtggctgcacccacaaacctgtgggcaggactctgaccctcacgctggcccgggtgggggcgcctcccgtgcccttggctcagctgctgccccatggaagctgctcctgacacccttgctacatgaccctgtggatttgccctcgtccccttcgcagaaggggaaccagagaaagcatttccaccaggcttttgaagtgagattcgggtgggggggtttgagttttcttttgcttttattagtgtctggtgctttttttaccctcttttctccatttcaaattgtatttttattctaataaaatat

SEQ ID NO: 2584 - DNA, 402 bp, Homo sapiens
gtgatggtttttctctcctgagcacatgaggatgcctgagcctggctggtcctcctgcccttctcagggagacggatggcgtgttccatctttgctctctgctacattgtgcatttgggcgcagagacaaattcagaaaggcttctaattatgcaaggaatcgaggtctcatctcctcagcacacttgtttacagcactgagccctcctctccctctccctccgccacacactggggctttgtcccctctggaacagacactggtcaacagcctggtgtcatcccacagacctcctgtgtgtggaccaaaggtcctcaacatttagggatggtcccctcacagggggtcggccctctgtgtctgaacgtggccaagccacgacccctgatggaaagttacaa

SEQ ID NO: 2585 - DNA, 627 bp, Homo sapiens
catggcctcgataccccagacagagtgaagactatgaggccccaagtcctcaagagggagaggggctgctgcctgcaagggagaaggatagagccaaggaagcaagcccaggggcccctgggagacactgggcgagattccagggggcagggtctattcccagaaacgagatggattggaacggccacaggagaaaggcaatgggatcggtcacctttgcagcatttgttgttaatggacagaggtgctgcccctcctggctcagccttgtctgcaagaccaagtgggtgcaggcgctggcctggttgctgggaggcacggggcaggagaagctgtgcccctctctccacagggttggagctagagctaatgaagtctagctctgtggcctgccatgcttggccaggtgtccctgcagagaagggaagctctactcagtccagacaaggccacagtgtcaacaaggggacgatgtggataaatcagcacaatcttgtgactatggctattggtgggaataactaacaaactaacaatgatgatgactgttaacggtcaagtggaggcagatgtaaattttagtctaacaaacaagaaagtaagaccaagtcatttctttattttctt

SEQ ID NO: 2586 - DNA, 403 bp, Homo sapiens
cgatgggaactccagaagccctgcctggggactggtccttctgagggctcaaagttcttccctctgcagccaggccatccccccagggatccccaagtcccctccacacctggaacctacctctgaacatccagcaaacttccacccttggtttctagttttctcaaatacagggagggaagtttcttacaaatggcttccgcttttgaccatgtaatataactcacactcacctcacccgaagaaacaaggaacataaaaaccgggtcaccccatgaaatagcgggtggggggaaaccagagagaagacactaaatcacgtgcctgaataagcgcatctctcacgagcaccccacagcagctggccaggggcaggtactgtcggagcctcaccacgcccagc

SEQ ID NO: 2587 - DNA, 66 bp, Homo sapiens
agcagggaatgtgacatcagaaaccccatccaagcagcagaggtccagggagaaaggctgccccct

SEQ ID NO: 2588 - DNA, 119 bp, Homo sapiens
tcccgaagaagaagggattctgttgaagacagcaacatggacaccctgactcagtttccagatcactgtgagactcagacccaagacaacaacaccaactcctccctaatttccagcct

SEQ ID NO: 2589 - DNA, 62 bp, Homo sapiens
attctgtttctttgaagaactccaactataatacatccccatctctatgtggacagtgtggc

SEQ ID NO: 2590 - DNA, 610 bp, Homo sapiens
tccccatctctatgtggacagtgtggcgagatttcccagggaactccagacttctggtcagagaattcaggaccccatctggcaccagctacaccatcagcctccgccccttgccacctctactgccacttgctttccctgatagcatttatttacttggggttcacgtgaaccttgatctcaaaacatccctcttagcagagaagttccaatgatgcacgagtatgtgtatgttgatttgagtcctatttatttttctttcaaaatattgaaaaggtttttctctctaaatgtctgtctactgacaagttttgatctgtcttcattgttctgtaattgccgctgagatgtggtattcagtgtgatgaaaatccccattgcattcctctaattgaaggttttaaggaaagaaacatgttcaagacaacgggcatccatactcaagattaggcgtcaccacccaggccagcgagccaggtagggacagtgtgcggacatgggtatgtcggctacaaacaagcgtccccaatcagttgggtcactctgtgcagaaaggcagccaagccatttacctggacccaaatagtcaaagagaggttttacatcacac

SEQ ID NO: 2591 - DNA, 40 bp, Homo sapiens
gaagaaaataaaataaagtagaggccatacccttctgctc

SEQ ID NO: 2592 - DNA, 1932 bp, Homo sapiens
caacccaccgagttagctgcaggtagtcattacgctaagatagaaaactaaaaaactagaaaaaattgttttttactttaccaacaacaaaaggacatagctgaaatcttagggagatgtactttccccaaaagcttcattttgacaagaatcatgcattcatgagacctcagaacactctggatcccgatccactattaggatttgcattttagggcagatttgtttttatagacttgaacatgttggatctttcgggccttttgaattttataatcttctcttatgcggcgagaggagtcagtgtagacagggggttaagtaagaaggaatctggaatagacttgtggttaatcaggtcaccaggggcagaaagggccagtcagggccaggtggctgagccagacaagatcaggttccttggacccttcaggaaaggactctcggcccagtcaccttgaactgtgctgggtgagccatggaaggcgggtttgtttattacaggagctctgagaccctctcattagggactgtgtactaagaatcccctggcgagcaggaatgctggagtaaatattgtgggaggcatttgccaaactcaagcaacaacagtgagcgtcagagaaggagccagcatttacccttggggagcaggtgccagccagcagctgtgggtctccctgcaggcaggatggctgagccagctgtggtctggccctgatgctcactgggtagggaagggatagcagcagtctctgaatacgcagaacctccggggccttcatggaaattgtctgggtgctttgagtgggaaccatgtcgcaccttttcttgaaaggtaaattgagtcaggccatctgaataagttttcccgcaaaagtcagcccctctttctagggctccagagtcccacagacctccttttgcgttcagcaccttccaagttggtatcacaagcacatgagccacaaccaagctaagcacaagccccagagcaccgagaagatgcctgcctagaacacggatgcagtgagagtgcctgctaatgggctcaaggtcccggcatgaacagccagaatcagaggggctataaaggagtcggctgggcatcccccaccctgggaaagagggcctcggcatccttccctcctcagacagcccagcgagtctcaccctcagcttcccgggccagggacctgctgcaggccatcactggctcaccgaacacgcagaggaagcaccgagcacccacatctgtgcccacctctaggctctgagcgcccaccccaaacaccaccctttatctcctcactcccccttccttcccatggaccatggtccccatcctcatggcaatctctgccctgatcttcaccccttccaggtaccctctccccaggccccttcaggcgacactcacttcccacccacctggactcaggaactgtcagctctgctcctggcagcacctctaagcctttgcctcctccctgctgtgccagtgcccatcacttccctaaaacttccttcccatttgggatttttgctagaaaaataagtgtggacacctggccaggggctgcctgatgaacagtagcagctggtgttgctggctggcacccaccccgtctctctgtctggggaggctgctctgctctctgtgttctctcccctgtgcctcccaccacaccacccactcccctgctcctcctggttcccttcttgcctgctagttgtaactgattaccatcttacgttgcaacttatactcctgggtgatctcactcattgtatgtctctacctattacttcagtgtaatctctaccccaggcctattccttaattcccaggtccccatttccaatagcctgagtgttctctgacccaaaccaagctcagtacattccctgatgtacttctctccccacctc

SEQ ID NO: 2593 - DNA, 311 bp, Homo sapiens
cataaaacttgggtggcatctgaacctctctcttttcctcacacctcctgcaccaactactcatcaatacttgcatcttgtgccaccagcatggatcaaccaatagtcttaatctcccttccttaagtgtgttaggatttggttcagctacctataacaaaaaacctccaaaccacagaaattaaaacataaaaatacattatgatctcacataaagtcacctcagatggttaggctctggaagaagtcctgacttagtctctggcattaaaagtcgggagcctccacatcagaggtttatttgggagaca

SEQ ID NO: 2594 - DNA, 38 bp, Homo sapiens
ccacagcattttccccaactgagcaccaagatgaagta

SEQ ID NO: 2595 - DNA, 727 bp, Homo sapiens
tgggtatttttttctttttttcctttttttccttacattaaatacatcagtaaatcagcagtcacattctgttaccacgattgttatgttaggagaggaagaaatgtaaatgctttcttagaaacaaaacaaaaagaaaaaaaccagaacactgtgcccctgcctccactgccttaaaaaaactggccagaagagaaaaatgagctgggaaatttaaaaaaactaacatccccaagcccagcagagctcaaaggaaggcagaagatctggtaggaagtagagggaaggtagccgattgcccagaagctaaggctagatcctgttcctataggggtgggatgggggagaagcctggataagtggtttccgagccccaagacaatgaaacaccttcactcctgctccatggggcaaagcttgacagagaaagaacttcatttctaagagactttagaaagccatcccagttcttccacttgtaaaaaggatgcactaagtgctctgggggggctagaggcttctcggaaaggcagggagaaatgtgtgtgtttcagggccatgggaactaaggctgccactggaaaaggaagggaactgaggcctaagtggaagaacctaagctgggcccttcagaatctcagcttcatagatttctcagctgttatggaatagaaggcagtctgcaagccaaaagggcagaaaggttctaatcctaggtcaccgtgac

SEQ ID NO: 2596 - DNA, 399 bp, Homo sapiens
tctctctctctctctctctctctctctctttctttaccaaaactctgggctggaacaaggaacttaaagttctcttttgccttgatggcctcccacagacatcttaaaacacgtgataagggacatgaagaaaggctagagatttagaaaggaccagtgtcctctgataatgagccagttgtaaggtaccttcagtgccagtcattccatgtccacagaaacaggtggtgtgatatgaaggtgccccaaggaggcctctgtggtacttgcccctggtggtacatggattaaaccgttggttgcatggtggggaggggtagggattaaggatggagggactaaattcaagatattaacaaaggaggaaagaagcagggcctgataggagagagaagacag

SEQ ID NO: 2597 - DNA, 84 bp, Homo sapiens; identical to SEQ ID NO: 2238

SEQ ID NO: 2598 - DNA, 750 bp, Homo sapiens; identical to SEQ ID NO: 2239

SEQ ID NO: 2599 - DNA, 1004 bp, Homo sapiens; identical to SEQ ID NO: 2240

SEQ ID NO: 2600 - DNA, 154 bp, Homo sapiens; identical to SEQ ID NO: 2241

SEQ ID NO: 2601 - DNA, 441 bp, Homo sapiens; identical to SEQ ID NO: 2242

SEQ ID NO: 2602 - DNA, 1106 bp, Homo sapiens; identical to SEQ ID NO: 2243

SEQ ID NO: 2603 - DNA, 3353 bp, Homo sapiens; identical to SEQ ID NO: 2244

SEQ ID NO: 2604 - DNA, 1571 bp, Homo sapiens; identical to SEQ ID NO: 2245

SEQ ID NO: 2605 - DNA, 42 bp, Homo sapiens; identical to SEQ ID NO: 2246

SEQ ID NO: 2606 - DNA, 1116 bp, Homo sapiens; identical to SEQ ID NO: 2247

SEQ ID NO: 2607 - DNA, 154 bp, Homo sapiens; identical to SEQ ID NO: 2248

SEQ ID NO: 2608 - DNA, 93 bp, Homo sapiens; identical to SEQ ID NO: 2249

SEQ ID NO: 2609 - DNA, 398 bp, Homo sapiens; identical to SEQ ID NO: 2250

SEQ ID NO: 2610 - DNA, 761 bp, Homo sapiens; identical to SEQ ID NO: 2251

SEQ ID NO: 2611 - DNA, 563 bp, Homo sapiens; identical to SEQ ID NO: 2252

SEQ ID NO: 2612 - DNA, 256 bp, Homo sapiens; identical to SEQ ID NO: 2253

SEQ ID NO: 2613 - DNA, 89 bp, Homo sapiens; identical to SEQ ID NO: 2254

SEQ ID NO: 2614 - DNA, 928 bp, Homo sapiens
ttgtgctttgacattaaaacaacaacaatatagatttaacacagctggagataactatttagccctaagagtcattctcaggttttgctaaagttcctagataaaatgaccacttcttagaatttcagcatgaaacctcaaaccctaaaactataaacttgacgataataactttataaggaaaataattatagtttatcaaatgagtagatttatgaataatcaaagggaaagaacatctttgctcccaaataatcaagaaaaattacaatttaaaccatttaagtatgtaagtgtcctgttatttgactcttcatgatagaaggtaggttcaaagtttcacagtatgaacagtctctttaaaatgtataaaaagctgtatttgtactctgctctcaaggttacataatctgtgaacattactataccaaaaacttgagaacacgattgtgtgtgtgtgactgagaaaaaaaaagtttaatactaaacaaacagaatagacttatgaaacccaacacgttcacaccactcaattccactctcatatgaagacagaaactttaacttaaaaatgacgaatcttagcaatacaatttgctgcattttcctttttcttacagactgcctataattggggaattccaagtggctgtttgtggcagtcaggccaaaaattctttcctaatcagccagcagcccctgcttcaaccaccaccctggccctgtggaatttattcttatcactaggagggaagtggaaaataggtactcttttgtatccatggacagagaaactagtatttttgtcctatgatgggagggatgagttagatgtgctaatgtggcaatgttgagccagtaaagtaggaaggatggtttgggaacagcagagaagaataaaagaaaaggaacaaagaaagagggaaag

SEQ ID NO: 2615 - DNA, 156 bp, Homo sapiens
tgtggtgaagagattagatattaacctttctttcagaaaaagtgtgtatttaaattaaggtagaagtaaaaaaaaaaaacaaacaaacaaaggataagatcaaagaataaatgaatgctaaactcatgaaatgttttgtaatagtaaaaatatatt

SEQ ID NO: 2616 - DNA, 354 bp, Homo sapiens
aatctatcttttttaaaaaagtagagtcaaaagtagccatagccaccttattctttgttgggtttgtacgtgtgtgttgagagggagagtgcaggagggagaaagagattatttcatcaccttaattgtattaatgcatgtataatcaaaatgatattgcaaaatgttaatttcatctttaaagggaaatctgctacacttatcaaagcacggggaaatgttcagacttacaaaattaacacaagctcaatgacttccttaatgccattcctccaagcatctcatagaaagtaaatgtaaaatatacacagaatttgagaagttagagagagatgaacactgtagcgtaatata

SEQ ID NO: 2617 - DNA, 189 bp, Homo sapiens
catagttaactgctaaaacactacagcaatatgtaaacagaagaatacacagcagcgattgacttcccactaagatcttgaggggaaaaacgttcttctgttctacctaaaaattaaagcaaagtaaagcctacatctagaaaaccaaacaattctggtgaatacgtccattcattcattcaacaaata

SEQ ID NO: 2618 - DNA, 665 bp, Homo sapiens
gtcaagaaaaaagtctctgaggtacgatctgcagtccagcctgaaggggacagtgagccatccatctcaagagctggacaactccaggcagagaggacagcaagcactggagagggctcggcgtgtctgggaaagtgagaggaccagtgtggctggagcacagcagtagagaaagcaacgcaactgcaaagaccaccagggtcttaagggatacacaggaaatatttccaaatataaaatctccaccccctagcctcatacaagacgcaggcatgcgtgcacatcccacttgccccaccccccgcctccatgcttaactttctttaggatctacgaatgtgtgtgtatatgtgttagggggaaggggacacactttgattctctagttgccaggctgtttcagaatagctttagtttacacaattaaagtcaccgaagataaaagtcactgaaaatactgtttaaccatatgatcactactaaaggagtaagggcaggacaaatccaatttgattatcatatgcatatcacccagtgttcaagtgaaacatgaaaaaggaacgctgtctgacgaaaaagaggatcaaccatgattatcgttattacatataattatcaccatctgaacccctgctatggaaccctgttctaaaatagaaaaggaa

SEQ ID NO: 2619 - DNA, 1268 bp, Homo sapiens
tttttttaatgaaaaagaaaactagatctacttctttctcccaaatcatgacatcttacgaagtgcaagtcaataatggtttaaattccatttaaaactatttacaatacccatttcaggttgtttcagattgtgtaggaggagaatgaaataaacagcaataaatgagagttccatggcagttcctaaccctagtgcatgtgtcaaagagtttaatgttgtaaaatgcttgaaatttttttcagtgtgaaatcatttttcagatggaatagataaaagtcagaatttcaggcatctggcaattctttctctttgcctaataaagtattaccagttgttttagtgaagcatattcttcgttaggtaataaagaaacagtgctttcttcatcctcattttgccaaaaataaattcatattcaataatagatgtctgtggcttttttgaattattttgtactgggttctgcccctcctccgacaaaaataacaacagacctagcataggaaactcagcataatcagctggcttaaccacacttaataaccctgctggtttagggtgggggataggaaggaagaagagagcggtactgaaccatagtgctgtgctcaaatgtgctgtcagaggaacaaaacagtatccacaatagtggacatctaaacaaaaaacattcaaagtaccttaaaaatcaatttaccttacagtatcttaaagcttccattagtgttaaaaatcctactgctgcttgttcatgtataccaagaagttctgcaaaaaacaacaacaacaacaaaaaacgaaaacttagcattgtagtagtgtgtataaatttgaaacgtacttatatgtatatatatttatactacaccaaaacttttaacttttacccaaaactatactttaaaacttagcatgtaatcattacagtactgctcattataaaataccattagatcaggtttgtggtgggtaaatgtgatgctttagatgtatattaaatgtatttataaaacttgatattcaatgttaactttttaaatgagagaatttactccctgaaatccatgccattgttgacaaaaatacaagaagaaaaagagactcaatacctatgtaaaagggctaacttgaattgactttgattttgaaaaacaaatggatatgctaatcactggtaaaatttatcattaggtagcagtgactccacttgcctaatacttaaaacatggacatttaatgccatccctctttcctataaacacagg

SEQ ID NO: 2620 - DNA, 86 bp, Homo sapiens
ggcaaagtttccttaaatgtttctggtctggggggacatgataaatagtgattaacacaaagaattaagaagtaagttctggactc

SEQ ID NO: 2621 - DNA, 443 bp, Homo sapiens
tcagaacagacacaacgcagggaataaaaatgtgataataataaagtcttttcataaacgatacccttcagctaacatacattaatataataatatatttgggtccataatatatctaaaaagcatttctttctgggtaaaaattatgttcactgtaaacataatgcatatataattttgcatcctttttaccatctggtcatgttttgtccatttttccattaggatatattttcttatcaatgaatgtagtaagaatattaactctgttatttttgtggccaacattttactgtgtagccttaactacaacatctagatggtgtaaggcaagagctgacagtttaactttctggattggtaaatccaaaattaatagaaggtgcatatacatacagtttatactttgtcactagcttcttacaggcacagatcaggtagag

SEQ ID NO: 2622 - DNA, 427 bp, Homo sapiens
gaaaaacattgattatttgctttgggatcatccgtaagagtgtaaagggcatgagattaaaaggttttagaatcttcaggttaaagcaaaacaagggagaggagaagaacagcccaaataggtataaatggatacttcatatcttcgcaaacttttctctccctttccttcttaaatgtaagcaacactaaatgttttcatgtaaaaaagaatacatacattgggaaacagtttcacaatttaatttctaaaatcagttaccaccacctagtgttacaattagatactacatcatctatttccctggacttttaaacaaatgtctaataataatatcatgttactaaatacagcaaactagttgttcataattcttgggtaatgaactatttagatttgatcagtaaacacatgcttagacatctag

SEQ ID NO: 2623 - DNA, 84 bp, Homo sapiens
ggatttaatattctcacatgttacgatttatagaatttatttgtaggagactttctcaataagccttgaaagtgtctattttca

SEQ ID NO: 2624 - DNA, 78 bp, Homo sapiens
gtactctacatttgcaaaaaaattcaaattactttgtgattatattcttgttttctttgccagaattaatttactatc

SEQ ID NO: 2625 - DNA, 159 bp, Homo sapiens
taactgattatcttatataaaagagaatgaaacaaaccatcaaaactcattcagtttctgactgcatttttaggagttccacatattaagtggaatataaccagacaagcaccagagaaacatgactattttttggcctaactataatatccgtttctg

SEQ ID NO: 2626 - DNA, 155 bp, Homo sapiens
ttctgtgtatgagtccatcatctttcaattagctatgcatttgactggctgtaatactgatttctttttataaaaacaaaacaaaaacccacaaaaaaccaagaaacttctgggtttctgaattacaagagttgactcttctatccctatcccat

SEQ ID NO: 2627 - DNA, 101 bp, Homo sapiens
tgtacaaatactgaagaattcctttaagataaaaaagagaccatgacaaaattaatctacagaaaatcaaaatcaaagaaaactttagctcaacatacatg

SEQ ID NO: 2628 - DNA, 176 bp, Homo sapiens
aaagagtgggcaagaatgcatttaatttgattagttctactgcagcttatttctgttctattggagaagcaaaagatggtttcaaaaactggggtagaatcaagtatatggattcaggaccatataatctatataaaacactgaatatttttcactaaagaatgtacaaaacaatc

SEQ ID NO: 2629 - DNA, 88 bp, Homo sapiens
tatctgtggagaactgactggaattaggacattagataattctttgagaaaaagtcaaaaggcagatcccaaactcataccattcata

SEQ ID NO: 2630 - DNA, 40 bp, Homo sapiens
tctgggggtgggagacacataaaattgatataacaggagt

SEQ ID NO: 2631 - DNA, 61 bp, Homo sapiens
gcccaaatagaagccatctaaaaaaaagaccaaatgatttaacctcataaatatgaaagcc

SEQ ID NO: 2632 - DNA, 37 bp, Homo sapiens
aaaaaaaattaacagatgcctaaaattttaatacact

SEQ ID NO: 2633 - DNA, 140 bp, Homo sapiens
caaggcaaaaaacagactaggaaaaaaatacgtttactaacatgagacatacattcattcagcatttactggacttgtttcctgctctgacaacatagtaggaggcaggcaatatagaaagaaaaattacaattaaatag

SEQ ID NO: 2634 - DNA, 270 bp, Homo sapiens
ttccctcaaaagcctaggcacctcgtttacagaagcaagaacatgtacacaaagaactatgatgcgaggtgtaatagaatgaagccgactgaggtaaagcaccatagatgatcagagggaggagaaaacttttcctgctgtcggggttaagtggagagacattaaatgggagttaacattttaatggggccagatggaatgagcaggatgacattttggggaaagtaccattgtttttaacgaccgggaggcagagccgtctgaatagaa

SEQ ID NO: 2635 - DNA, 296 bp, Homo sapiens
gccaagtttgagaaccagtggattaaagcactggatttgtgaaggagactagtaaaagattataaacatagggttgagtacgaacacagaggctcttgaatgctaagaagctgaaactttagttggcaagcattagcaagagagtcattgaaggcactgagcagagaaataacctaacaggacgtgtaaaataaaatcattaacttgtcagtttgcagaatatactggagtggaatgacagacagaaagctatagcatgatagtctagacaggtgagagtaatgagaccacaacag

SEQ ID NO: 2636 - DNA, 1374 bp, Homo sapiens
tttacaaatcaggttcctcttaatttctggaagactccaattaaaaacttcatgtaagttattttttgtccgtttagactggaatttattagagacgacttcccctcaggactgatcttatggtgtaatgacttcgatagggttatgtaatggaaaccatattatctttttgattgccacaacccttcacagttcttcctctttgggtatgttagatctttcaaacatatcctaatggttctctttttttttttttcttctccgagaagaaaaattatgggtgtcagcttcctgattgtgatttaccaactagaggcacagtctctgcaggaaatatgtcagctgtctcattcctatcttatttaaagtaggacagacaccaagcttgagaaaacttggacaggaggactcagaggtagaaaatgcaagcaaacatgtcagtttcagtcatgactcacaagctccaaattcacttatggaatcatttggtgaaatcaaattgatagtgagaacagggtgcagcaatgatcagaaggagcccaaagagctctaatgtcattttcgcagcctttattcttggtgtctccctgaagaccatttacttggaacctagacaggagactaaagtctgtgatctctgggtttgcttagctctgtagacagctggtacatcacatacaaaatattaccccacgctctcatagtgtgatgagttgttaataaatccattccaaattcttggttctcattcctctgaatgtagatagactggctgaatatggatatatcagctctgcttatcactctaaatgtcatctgtctttaactttatccaaaacagttttattttgcttcagagaaagcagtgttctcaacttcttgaaaatccaagccaagaagaatcatagaatgaagaattatgctaaatatttggtcctcagccttcctggagctgtggcatgaagcatcagtggcctcaatatgtgttgggttttcctcggaataatgaataacacgtgtgctttaaaaaatgtatgtacatttgagagttttggcatagggaactgtccataattctgtctcctcaagtcattacaagacattttcctgtctttccatatttccacaaagagagagtgagtgtataaaaaattccctaatattgtttctgcctcgctctcaccctgtccccaaatagttgctttttatggtttgctttctttctgaagtcccagtataggcgatattttaacatggtttaaagcctagactaaggatttggacaacacagtttgaatcttcagccatttcctaactctgcaacttttaataagatacagattcttcttctgaaaatgagaaaaataataggtg

SEQ ID NO: 2637 - DNA, 158 bp, Homo sapiens
gtagcatgcatgctccccccaccaaagaattgagcaaatgaataaatgaatgaatggtagttatttgctattttccagtagttgtaatcagaaatgatattcaaaagacgaggcatcaactagttgcatgaggctttaatcctaaatggtcactgcat

SEQ ID NO: 2638 - DNA, 151 bp, Homo sapiens
cagcccccaactggtccggaggtgttttattattcgacagttggctggctgtattggtgtgctctgtctgaatgtcagccctgcttgtcaacactggcaataggtcttccacactctttcccaatccctttttgatcccaaacaccagcat

SEQ ID NO: 2639 - DNA, 688 bp, Homo sapiens
gtgagatttgagccactggcctatgcagccagcttctagtattaccactgcctgatctttttctaccttggaaattttcattgtaaccactccatatttttgctatgatcaggcttataatgataaggcagggacttgaacattgcagggtgggttggcacacctcttcagatggactagctagggcacatgtcctccttccaattttctcttaagttgaatcactcctctggcttggccaggaggataccagctttgccaaggtgactttattatgtgtatcctggtacacattcccttttgtgtatgtagctctgtttcctggcatcattatttttggtagggttggggttgacttctggctatgtgctatctttccagctgaagtgttttgttcctccacttcgacattccatgaagccttgtgaaaacacttgtcctcttgtcggaaggttgtttgtagggggttatattgccctaaacttttccttccaggccatggtgcgatccacaggactgagacgagctgcagctctgctgctcattcactgcaggacttagggcttaaaacttgatttctctgagcctttattatcacaactgtaaagtggagataaggagagaacaaaagagataatgtgaatcgaagtataaagcaattgaaggtagtcattcattctaccacgca

SEQ ID NO: 2640 - DNA, 55 bp, Homo sapiens
atagaaagagtaggaattattaatagtaatgatagttaaaattagtggggtgctt

SEQ ID NO: 2641 - DNA, 25 bp, Homo sapiens
taaatgaataaaaaaatagtgggat

SEQ ID NO: 2642 - DNA, 43 bp, Homo sapiens
aaatctgttcatgccatgcccctgcttaaaactgaccatttgt

SEQ ID NO: 2643 - DNA, 1163 bp, Homo sapiens
acaggaaaaaaccctgagcatttgtgactttccattgctcatagcataatgactaaactcctttacgtccctaaaactttcctgcccaaccctctggtcttactcttcatccttttctctgccccctaccccatggtcatcagcctcagcagcagatcataaaggatatactcagctaaggagtctgagcttgtcctatcaccaacagggagccatggagcttttaagcaggttgaacaggagtaagacaagacctgaaaaagccagtgaggaggctgttgaaataacccaggcacaggtacatgggggtgtgaactaagggaaagaaagagtgagggagagggagaggggtgaattggatttaagagacattagcttatggaatctacaaatcttggtgactgatgatgcaggggagtccagcagagcgaggactctaggcttatacccacagttctagcttagacgacaaggtagagggcactagctatttttgaggagctgctatcaatgcctaacaaaagccaacaatactcatgattctgcgttttcactacgtgtatgttgcaaggccctgaaagctgtaagatagtttcctttccctgtcccttttgttcactcccttccacactgagtgtgggaattcactgaaagctcagcaaaacccatcacctctgccacacccccgccccccgcctaagttgactacaaacccacacatcagacccaggttagcaatctaacagtgcctgaaattaagtgtttaaacattaaaaccaatcaagcccaaagaacctaacttgaaatgaagaggtgtttaaaagaagtaggctaaggtacaccgagaaaaacaacttaaattattaaagtggagttttcaccatgcaggaaaaatgtttcaataatgtcagattaaaaatgtaaatctatttaccttccagatgggttttatgagagctcttattaaaatcagctgcctacctgtttgtgaaagagaatttgttacttagggaaggtagtcagacccaggcatgctggaatcattttctcacatttgtcgctgactgaatagctcctgtgacttctgctttgtcagttaattactgtgtaaactttcccactgaaaacagaggcttattcagtgttgtggttttttttttttt

SEQ ID NO: 2644 - DNA, 331 bp, Homo sapiens
tcagtgttgtgtttttttctgaatccaagtgacaaatgttcatgttgtccaaagcggatttcttccaattcatttatcgccttcctcttgaccctgtagtgcatttgtaattccgaaattatgacattaatatcacttccatatcaatgaactttgtgtctaggttatatggttaagagagctttgagacagaattagtcagatggagaaactaggagggaaaaaaagtccttcataagtcagtgatggacaagaagacttattttcaactatgatgcaagaaactctaaagggtcatgtgttcattcatgaaataaaatattatctatat

SEQ ID NO: 2645 - DNA, 148 bp, Homo sapiens
tgcagttcagtgacagctttcctcatcaaattgatagaccaagaataggtttatacatgtaataaatctaccacctttttttttccagttgagaaagaaaatgaaatgtgactatgggaaaacctggccaaaatttatattatatgcc

SEQ ID NO: 2646 - DNA, 47 bp, Homo sapiens
agttacctgagtctgtggcctcctgcttttatattgggggtagaaac

SEQ ID NO: 2647 - DNA, 500 bp, Homo sapiens
agatgtatttgtgagggactcagtgatcttccaccaggcagcttctcagtaggcagtttccaccacccactataatttggagtagagtaagccttccttggctgaatcctcaagtgaatttctattttcttctcttattggagagaagaatgaaaatcggatgaagggaagagagagcagagaacaagaaatatggaaccatagaaaccatgagtcacagaagtgactgggggagtcgaacgtctccaattatctctgcttcttatgaagtgaatgaagctaaggcagacttggtgtcagtaaactttttgtaggtaaggttttttttttccttggtccttctagtgtctctgctccttttatcttcttgtcagttgccacatgttcctactcttattcaagtttaaatattttttttgaaagtttgaaaggtctgcgtcttaggtgctttgtgagagaggtaatgatattgacgattaaaaaaaaacctgtgataacaa

SEQ ID NO: 2648 - DNA, 51 bp, Homo sapiens
aagatcctatggaaccattaagtcaaccctatggatgaccttaaaggcaga

SEQ ID NO: 2649 - DNA, 34 bp, Homo sapiens
acaattgccttgtagtgtgtaccacgaccacaca

SEQ ID NO: 2650 - DNA, 482 bp, Homo sapiens
agtgaaatgagcataggagcacatctcagacacaccacaagttcagtttatgctattttcacctgtaatgttgcagaggctgctgtggggagtaaatgagaaaatgtttgcaaattacagagcattgtatggaggcccacagagagacgacattctttcttccctccttcagcaatgtgaaaccgtgtcagaagcacacatgcatggtcagagtgtctcttggtaaataagagacataaagcactttgttttttatttttattaaaccaatcttaaaaaagattgattggctccatagacctaaacgattagcactgaaacctctcacatttcctggaaactgaatgttttgcgcttggaattctaaagaactgggaaaaaggagagtaataaagtataaagaatagtttcatctcctacccagcttatacggtgaggaggaggttggcagtgatttagtataagtataaaaacaacagtcg

SEQ ID NO: 2651 - DNA, 51 bp, Homo sapiens
caacagttgaccttaaataaggttttacattagtccaaatgatttcaaaga

SEQ ID NO: 2652 - DNA, 263 bp, Homo sapiens
gtgtgtgtgcctgtgtgtatgtgagagagagagaacgagagagagagtcagagtcaaacttgcaaagtaaggaagttgatgtgtccaaagaaacctaaggaaataagaactatagcagtgggtcagttgcattatctttccgtatccctaatgtttggaggcaaatgagcagctgtaggagaaattatttgcttatttgcctcctcagatattattatcaaaggcaggaggcctcttcccaacaagcttcccggaacaatgca

SEQ ID NO: 2653 - DNA, 384 bp, Homo sapiens
gggacgatctccataatattcatcaatcccaggataaaagccccgaatgccaaatcatttagataattgatttatattttccatgtgtactatgaactatggaacttaacctttcctccctcacatcacattttctcattaccttgaacaatcattggtatttttaaattttgacctgatcctttttagcctttatgtttccagactacagcacgcaattacagagtaaagtaattgaatcttaacacccttgagggtgtctccagggcatcccaaaatctgacgcaggcatcccttttataactgcccctgtacccataccttcccctttctttcagccaggtggagtttgtgtaaataaactcaacccttttgaggggtgga

SEQ ID NO: 2654 - DNA, 200 bp, Homo sapiens
tttgcgttagtcttttgctttttttgggtgggggatcagagagagtggagcacagaagtgtcatccccttcttccaccatctaagtcttttggggcttttcaccagtgccctctggaagcaagtgcattggtgcagctatattttttgcatttgggtatctgcctttcatgaccttttcctttttttaattttatttttt

SEQ ID NO: 2655 - DNA, 1366 bp, Homo sapiens; identical to SEQ ID NO: 2326

SEQ ID NO: 2656 - DNA, 162 bp, Homo sapiens; identical to SEQ ID NO: 2327

SEQ ID NO: 2657 - DNA, 890 bp, Homo sapiens; identical to SEQ ID NO: 2328

SEQ ID NO: 2658 - DNA, 84 bp, Homo sapiens; identical to SEQ ID NO: 2329

SEQ ID NO: 2659 - DNA, 313 bp, Homo sapiens; identical to SEQ ID NO: 2330

SEQ ID NO: 2660 - DNA, 1065 bp, Homo sapiens; identical to SEQ ID NO: 2331

SEQ ID NO: 2661 - DNA, 944 bp, Homo sapiens
ggaggggtatgcatacacatctgtgcccctgtgtagatgtctctgctgaggaccagaaatggtagctcacatatgtggtttgtggcttgttaaaaagcagcccttcatatggaggcacccaaagccattaactttatacattttgtttaaaaaaagaaaaaactctgcttacccgttagtttactaccaagccgtatcaaatcccacacactaactcttaaaaaatattttgaatctctctcccaaaaacaaaacagaccaaatgatttgcctgcctattgatactctgtctccttggtgattgtgccatgaggcttggaagtgacttctccaggtcacctcccatttacctgcctgctggagctttaatagaagactcggtattgagggtactaaatgttctcagactccaaaaatacccagacatctctgtgtgctccattcaacctcctatctattttgagaaaaaactgtaatttggtgctcctacagtagaacctcaaatccaactcggaggcagttcccgtaactgcctgctttgcaggcttagcttgccttttaagaaatgatttatttgcctcttagctgtattgagaactctgtcttcccctgtgtatctggcatcaggaacatattgtaggcctgtttactttaggccacacagatgacatcaacactatcttactaaaacagaaaggctttcaatttgacagaaaatctttaaacctacctgggttttgacaatttgacacaagtattctcatcttaaggaaaagcccaggatattggagctcaaggaatcatttattttgtctcagcaggaaactggtcgtgcagtgtgactacctgttaggctgatggattttcgagctctgctcttctctgctggcgaaggcctttggctttttcctgcagacccagggcttggcaggaaagacaatggg

SEQ ID NO: 2662 - DNA, 540 bp, Homo sapiens
aatctgccaaatggggataagaatgaagagatttttaccttgcaggaaggtcagatggattagtggtattaacagtacccaagtgaggagctccttcagttgcctggtgagaggtaaagtgtgttgaaataattaattgctatgaaaataccagcattcacaaatctttttctcaaatcaacccagggaggggctacaaagcccagttttcatgggccacagcttgaattggcctatccaaagcccagccattggcaggatctgtttattcagaggagttcttaggacagtcaggagctctacccaggactctcttagaaacctgcaggtggagtgagcatttatccgaagagacagcctgatacataagtggagagagctcctcattcactaaaatatttttaccttggcattgaagttgacaaaactaagagctattaactaacattaagagcaggggcctcaaaggatgtgaaaaccacagagagtgtgattccaacccccaccttccgtcttctcccccttcatcttgtgcgcttg

SEQ ID NO: 2663 - DNA, 226 bp, Homo sapiens
tatgtctatatgtagaaatagttatgcctaaaggtttggggaagaagaaaggagactgtatgtttcaaaataaggtttgaaattttgagtattggatacgagttaaggcaggcctgggactcaaactgccagggcatgagtcctggataatcttgtctgggaatttgatctgggcttggggggagagagcgtgttagttatttagtctttctaagcttgagtttcg

SEQ ID NO: 2664 - DNA, 35 bp, Homo sapiens
ataggacaactgactacggggcaaaaagtagactt

SEQ ID NO: 2665 - DNA, 438 bp, Homo sapiens
tttaagagccaatttttatagtctgtaaaggatttgatatggtatttggcataagaaatagtttagtagatgttagctattattacttatggtcagaaatgcaatacagagatgatcaagagtaggctaaaatagatgggagttttaggaagagacaagggagtttgagagaagattctgacttgatttttgagttggcctaaatccttggagacttgcttctaatatatatacactagtcagttgtattcaaaagtctctatagcaaccacttttatcacttgaaactaagtacctctgaatagaaacactcacgcatgattgcatgctcacaggaaaggatataagaagcttcacttattttacaagaaatctaaattttcttgcaggctaatttgaatcttaaaagaaaaggatatttattagatgtctactgtc

SEQ ID NO: 2666 - DNA, 374 bp, Homo sapiens
tgggaaagtttcattgatggatgcacattttgaggcattgtattataatttgaaacgagatctctaaattagcaagttctggtgttcaattgcataaataagaactggtttgcaataagaatcagatcaaagtttagttacaggtaaggatcatgccttcagaggaaaatagaattattattgacattatttataatttgttagtggggtggttcattataataaatgcagcctagctcagttttcccagtaaggtcatcagatctgagtggctgcatgtaaattgctacccaagggtgacattccataaagagggatgtgtgtttgagaataggtagcaccagtccagtggtgggaatagatatttatgcagt

SEQ ID NO: 2667 - DNA, 38 bp, Homo sapiens
gctgtttactaaagggctgtggaggtgtcctcctaaat

SEQ ID NO: 2668 - DNA, 330 bp, Homo sapiens
tcagccctaaaccttttctcccacttagattgaaaatatactgaagcatcaccttcctgggactcccatcaaaattcttgtctgtagaaagctcttgcctgtggagaacaggctcaggctcaaccatctgtatttagggacacaaggaaaagttgcctatggacaattgcctgttgacttaattttagatttagcatctcagttggtttcaatgatcctgggcaattgtgctttttgagaggcagtatatatgaaaacactttgcaaaaatataaaagctttagttatccattccaaaaacattcacgaaggcgcaccatatgctaggca

SEQ ID NO: 2669 - DNA, 1133 bp, Homo sapiens
aaaatgtaattgggtatcatcatttccatttctaattgtttcctctgcctgcaacaggaacaggacaggaccaatttgcaggtgccatccggggtctcagagcccatctcaaagtgtggtgacctagatgtcatctttgaatatagagccgccagccagaagctcacagtgaccattgtgagggcacagggcctcccagataaggaccgaagtggtgtcaactcctggcaagttcatgtagtgctgctgcctggtaagaaacacaggggcaggacgaacatacagagagggcccaaccccgtcttcagggagaaggtcacctttgccaagctggagcccagagatgtggctgcctgtgctgtccgcttccgcctgtacgctgcccggaagatgacccgagagagaatgatgggagagaaactattctatctcagccacctgcacccagaaggggaaatgaaagtgactctggttctggagccaagaagtaatataagcgtgagtatgttaaatggtgctgctaatgatgtggtgtgttcgaagacctgggattgtcagcccttgatttagtacgttcagtctgtgaattcagagactttaatttaattttccatttggctctcctcacccttgtaagccatgatttgcacttcatggtacaatgggtctttcatgcctgtcttcctgataacctgatggataaatgccctgtccattttaggacaaaatagcagcagtgtggtagagggcatggagaaaaacagggaaggtggcttggccctctggattgtggataactgatcctactcctcctgcccccaatctgcatcatgatgaatctcagagatgggactttctgggcaaggttcttaacgggtatgctggggcagactgagagagcagcccagaacttcagctgcttctgaaacctttcatttgtgttactaccgtcttccctcataccccatttccctgcttgccacagggtttcaaggaaaggtgtcataatttacatgcctacaggatgggcagctcactactgctgtgggttatatgtcatgtagtatgcccatctccttttacaaaaccacgttaacagatcagggagctctgtaggctctggattcaatcag

SEQ ID NO: 2670 - DNA, 122 bp, Homo sapiens
ttttttcttaatatctgagtaaagcacatcggaaatgatggaaaacagaatgcagtggagatcagaagggatcctgcgtgatagagcttgggaatggggatgatcacacccatatttatgct

SEQ ID NO: 2671 - DNA, 42 bp, Homo sapiens
tggggaaaatgagctagtgtaaaagaactttgcaggtggaag

SEQ ID NO: 2672 - DNA, 1792 bp, Homo sapiens
ctgagagatttatacggattcagaatttgatgggagaggcaagcagtgagtgacaggtgccacagcgggaagcttttataggagcacaggagggggagtgagtctcacttaagagtaagcaaatatttcattgttgaatttttatcttctagacagcagggtctgtaagacatctatcacgaccacctagccctgccgtttacaaactatgttccatacagcctcaggttaggtggggggcgctctgcagaaatgtctgtggtttggtaaacaggatactttcctgcagatgggcagaatatttgattccttttattggttctaattattgagtttctggtcagaaatttgaagaaatgatttcaaacattgagaagaaaggtttaagtcaagtctaatgcccttgtttctggtggaggagatggtgtttcagggggacaggattgcctgcccccacagggtcgattcctactcccgtgccttgagggacaatcagtgtccttctcagttttgtgctcctcctcccgatgtgcccgtgcctggtggggaagtgtaggtgctcaggagaagcgtgcccatgaataaacatgacagaaagctcaggttctcctgggctcacttggtgcctgccaggtcgctgagacccacaacccatgtgttgtcttttttctcaaacagttgtaaacgtgctcatttgtaatgtaagttatttctttaaaaggcaaaatttggcacctggcatatatttaacaaccttaagcagaactaggagccaaatgttctatgtgggggtagacgtccagtggtcatttcttttatagttaagacacaacgcctcctgtattgccatattcatcaaggagctgcagagaacagaaacaaacctcaggcctggagtggaggggttccttagaaacatccaagcacagattacacaggggggaatttgagtctatattgaatgtattattaactctccttgtatcttagagggtttgatttacactagtaataacgtctttgtccgttttgcctttagagaggaaatattgaatggagacagctcttgaaacaaatatgtcagttcctaatgcagggatctcatccgtgactgtgctccctgggcccattgtaattcacgccgagtgcgcccttagtcatctttggcagtcattggggattgggtcacaatttcaccaaacataatatcggctttctctaaaagagagtagtgcagcgtgggccaatggattctttgttgttcttcccctccagagtggagggtctccgctcagcccatctgcggtttctcacagtgatagtacttcatccacgcagtcgctgtctcatggaggggcgccagagctgttggtggggctctcgtacaatgccacaacggggcgattatctgtggaaatgatcaaaggcagccatttccgaaacctcgctgttaaccgagcacctggtaagtgtgagtctgttctcccagctctggttcttccagaggcaagtggaaagccctgtctgctttcatcttagttctttaatttttaccataaaaatgatcttattatggcttaagcaagctttcacaaagagatacctctgtattttttaaatggctctctatttaattagacttctttgctatctagatgtttctggacatgaaatagactggcctgtgtgtctatattgtttaaaggaaaagaatgaacagcattttcagcaacataatgtgtatgggcaattaaaatctgctaatacgtcctaggccctcaactttaaagaa

SEQ ID NO: 2673 - DNA, 87 bp, Homo sapiens
atggttgtggtggtgacagagaaaggaagtaaaggaggcagatctggggcaatgcaggactggctttctaggggaactgccactttt

SEQ ID NO: 2674 - DNA, 651 bp, Homo sapiens
gggcaccaaactgttattgaaagaaggatgaaatcagtatatttgtggcaggctgaaagagtcagtgggctcaggcctcaggtatcagcagcaggtgaagaactaggagcaccactggaaaagagtcatctcctacaactgaatctgggctctcactctttttttgcccttaactatgctgcagcccacaaaggatctgtggaatgggggtatcttgttagtcaacttgtatgaaaaccattaggagggcaaattagtaaggaatgccccagcactttggataacagaatagactgggtttatcagccatattctatgtcgacactcagagccacatgagggctatttagaatgcataatagatgcttattattaattgcatagctagactctttttgctagataccaatttgttttccagaatagctctgaatttactagagatctgtctggatttactactttgccttctgaacttttgctaacctcttttgctgtccttctgagatcaggtaaagtctgaacaattttttaggaacagggtagagatgcagagaatgatggggttgtggatcacacaatcatggcctattcaagtccatgctgggaagctttatttggtatattgggtggtaccgggcaatccagagg

SEQ ID NO: 2675 - DNA, 145 bp, Homo sapiens
gtgtatactttataagtttgcattcctgtaatacatgcaaaactgtgatgttgaggatggaactattatatcttgataaatatctacataaatatgctaaagatgaaattcctgtaacaaatatttaaaaccaaataggaaaaaa

SEQ ID NO: 2676 - DNA, 690 bp, Homo sapiens
ggacaggagccaggagaggaatggagctgtgagtggggaaaggcggaggccgcatgccaagtgcaccgctccccacggcagagggagagccggcggcagcctggggcctgctgcagagtccaccacagggtcgccgccggccaggggaacttgtaccactgagggccatgacagcttgtggttgaggctctcggctcaggtgcagttacctcttccgtgacctcaatcatgcccgacggggcggtcatgatcacataaagaatggttcttagggaagtgtgaaggaaaataggttgagcctgagtgttaggaacttttcttctcttgaatattgttaaggttttacatgttgctggaaagagagacagcggctaggatttagaagtgagaatctttttgcctcaaaatatatcataaaacaaaaggcaactttgaattcaccaacctgacccggttagataatcggatattttttaaacttttcctcctaagtaagacagaggaactgaacaaacagtagatgaagttcttctcctctgttggggtttagaagaaataagccactgagatagaaaccccctccccttctgaggtaaaatccttgggcgagagggctcctttctctgatgggctggaggtagtggggccaataatagaaatgtgagtctctgccggctccaaccagagcct

SEQ ID NO: 2677 - DNA, 71 bp, Homo sapiens
gagcaacaatggctacaattaaaatggattaatggatgaatagaggcacagatatgtgagaaaaaataaaa

SEQ ID NO: 2678 - DNA, 314 bp, Homo sapiens; identical to SEQ ID NO: 2343

SEQ ID NO: 2679 - DNA, 266 bp, Homo sapiens; identical to SEQ ID NO: 2344

SEQ ID NO: 2680 - DNA, 53 bp, Homo sapiens; identical to SEQ ID NO: 2345

SEQ ID NO: 2681 - DNA, 276 bp, Homo sapiens; identical to SEQ ID NO: 2346

SEQ ID NO: 2682 - DNA, 1206 bp, Homo sapiens; identical to SEQ ID NO: 2347

SEQ ID NO: 2683 - DNA, 2368 bp, Homo sapiens; identical to SEQ ID NO: 2348

SEQ ID NO: 2684 - DNA, 789 bp, Homo sapiens; identical to SEQ ID NO: 2349

SEQ ID NO: 2685 - DNA, 1775 bp, Homo sapiens; identical to SEQ ID NO: 2350

SEQ ID NO: 2686 - DNA, 125 bp, Homo sapiens; identical to SEQ ID NO: 2351

SEQ ID NO: 2687 - DNA, 127 bp, Homo sapiens; identical to SEQ ID NO: 2352

SEQ ID NO: 2688 - DNA, 321 bp, Homo sapiens; identical to SEQ ID NO: 2353

SEQ ID NO: 2689 - DNA, 339 bp, Homo sapiens
gttttcttcaactttatgctccagatttgaacattttttcttggtcattattgtatttttatttagcttgtctcactctttttataatttttggcaaacaaattatttcccaaagcagttttttaatctctaatatacccattattatagcaatataatctcaattcaaagcagcaatggcccttttcagtttctcagaaggtaagaattacatttttttagggaatcaaataatttttatgttttcttaaattgaagtataacttacaaactgtaagtgtctacattttagatgtataattcaataatttgggttgtgtttttgtttttttgtgtttt

SEQ ID NO: 2690 - DNA, 1453 bp, Homo sapiens
attgtcatttcccttaggtaaagatgctacataattcagattgtgagcaaacacagccacatctccccatcacccatagctgttaaacttagtaaggaataatttaataggtaaatctaaaataactaaattctatcattaaaaaagatctgcaggcagaaacaacaacaaaaaatcattttctgttgcatatcctgtgtggaggatgttgtcaacgaaagctgggtcttcatgggctcacacagaaaaaataacagactcctgtataaatatttttttcagtatcaacatagatataaacgtttagttttttccagtgattttggaaatgtaaacatcgcgtgtggagaacgcgttagcttttggaatgtgtggcaatctgtgatgcgcacagtgaagtgagtaccatgtggtcagggaactgcacgcctcccgctgggtggcagcgagtgttttcaggttttaggttgtgcctccagtggagggagagcttctgaccatgactatcaatctgaggtgtttcatcttgtcctcctccccagcccctcccccagtcccgtctatcagaatcttttacagcaggaggatgataggattcaccctacgccttcacctaaggacacagtgtgtgaaaggtgttctgcaaggcagaagctgtcggtacattgcagatagaaggaattacagctcaccgggcctctaaagttttctgcagaggcatagagctggactttattgattttccgattgtataggaaattattgtatgtttcctttgcagttgagtagatctattttccagaaaggccaaaattgttgattgtgtgtttgtgtgagtagggggtgcttaataatgtgtgtaaaggggataggttggttaggatgcaggctcctcaaatgcaaaaccaaactaatgagggagataaaagctgatttcatttcttgttctcccctccatgtcttttgttgtggcatctggagttccttctctcttagacttctgtactcaaactaggaattcattcatccccaaggcaacaatttcatttaatttagatcgctttttttttggtgttttttccttgggttatatttagttgctgtctacatatttacggcaagagaggtctgcctggctcctatttttctaaacatgtcttaattatttgtctgcggccctttcttattctttgttcattctacattatttgtttttctcttcccttcctagaaattttattttatgttacatttaggaagagatttttatcttatcaaaccaatcccatttgctttacacctacaaatttctcatttggcctgctatggaattcttcgttggtttccagtgctattcaaaaccttttcttctaagaaatatatatttttctgccatttgtagttatttgggtggcaggggaggtagattgtcagttcaccatcttgacttaaa

SEQ ID NO: 2691 - DNA, 253 bp, Homo sapiens
gacttaaatttcttgtactagttcttgtttcttatttgtttctttaaaaaaaaaaaaagatctttgttcattttgtaaaataatgtatagtatctctagaaaattgagaaaatatagtcaagcaaaatacattcaatcaaatgcattaaattttgcaataagtttccttgctaaagaaaataatattcacatcttaatttcagtggcaccatactacactgcaacaaaaatctcttagtttcagctttattaa

SEQ ID NO: 2692 - DNA, 2254 bp, Homo sapiens
aaaacaaaatttggtactattgctactaaattctattcactacaaaaaacagtcatagaatctgctaaaaaaaaattatgacattagtccagttaagtttgtgtttggatacatgtaatcaaaaagttggagttgttttgcttcacatggagaccccttcagatgggtggcccatgtctgataggccagccgcatggacacagccaggcttgctcttctgtccctgacttcttcttggtgcccattgtcctcatttgtacaacatgcctggcagctccaggctgtcgtctgtggtcctgtcatgagcatgtatcaaatgaacctatatttttttcttaataaatacacttggtaaagtttcacttacaccttgtcggccacgtgacccctcttaaccgcaaatgagcctggaaatcaggttttttgatttaccccaattccctggaacaaaaccaagatactgttaaggcaaatggagtttgtggcaggcacatcagtgtctgccacagaggccagtgtccttagagggctgggcacctacgtggcacataatagtgctgcactaccagttggatgcaattgtccatgcacaggcagtcataattgcatatattgccacacatatctcagtatgaacacagagcagaatacacaaacacattagaaagtatttgcctgaataagaatggtacttttatttctccatttagccagatgatgcttctctcaacagtactaccctgtctgacgcatcccaggataaagaagggagttttgcggttcccaggagtgactctgtggtaagtcatccatgtcagcacagttacatgtcaaggtacagttgcaagtcaaagcaactaatgtaggaaggtaagaagaagcaattctttaaaacattaaaaaatacttgagctaagattgcaaggaaaccacagctgctggtagaactactaactttgtaaaaattaggaagaaagaggctcaaaataaatgaggactccatggattcatgtcactgcagccagaaatcaaaggatgttttttatgtgtatcaatttggaggaatttgttaactttggtcttctcagctgagctcactcagaaaaatcccagaggtttgatgacgtggcttaactaccgtcttaacccagaagttccttttacccacaggataaattcaaaaccttcatcttgatgttgaaggctctccactatgccttagttctcaggactcactcatgcaaactctttaccttcagatgaattcattcacttggtcttaagtaacagaacttgtacttttgttttgtcaaaaatttttgtcattccccctcccgtcacccccactgcgaatccccattcattgtctctgagcaggagctctgcagggaggatatgatagaccctccacagaagacagtgagagaccccatcagatgaggcaattgttttccagtggctggttgatggaaggcagcagttagcacaacagccactcagatggaggtggcacattcaaaggttctgctggggcagtttttcctcaacccctgtccatttcgagaaacaaggagctgatgacatttacatgcatgacacattcctaggaaatccctgttgtttagggagataatgctgttagccccacataaattaactttgctgttgtgtttttagatttttgtttatggtattgttttgttgcacagtgatcatgtaagaggaataaaataatatgagtgacttttatcattgattaacttactaataactctgtaggttatggcataaataggctgagggttacccacaatatctgacccactgactgtaaatcagctcttactttcccattcaagaccaggcattgggatgcaaatgagtgagagtgtctctgctttagacgtcatctcaaattcatctcacttattaatgaaaacaaagtcagtcattcacaaagtctggtaactgttcgaataaggagtgacctgcagtagatcttacacagttgtgctattcccttgtgactggggactcgtgccctgaggacttgcccaggatcctttatcttccaccacagcttgtggcacccatgtgcccaacagtcacccctgcatggcagcctcaactctgcctccctcctcccctcttcatgcgcatctctgagacctgtgaatttcatcatgtgaatggttgtaaaatctttctgctcccctcctgtcttacagtctctcagtacagaaactcattgtta

SEQ ID NO: 2693 - DNA, 344 bp, Homo sapiens
tcgcttacagcctgcggtggttctccaactttctagttaacctggaagctcctgacatggtcagaccccttgtcggcctctgtagctggctttaacacccccagcattttgtacaagcagcagcacaggactgcgtgtggttccatgcacacaccaccagaacttggaggaggatgattgtatgattgagttgccaaaggagaggatggtaggcatgccttcctttctaggtgtttccatggcagctccatggccacaattttatttctggtaagactgctggtcatatttttctatttctttattcttagctgcgaatttcttcgcatcgttggttcattcag

SEQ ID NO: 2694 - DNA, 683 bp, Homo sapiens
gggtcttgtgtggcagttatagagctgtccagggtaagttaatcacccagattttatttttattttcattttgtttttttctgaaggcaggttgaatgccagtaatgacataaataaaagtttcagcagtattgggtctaaaaaatatctcactggcactggccttcgacttgacttaccttggattgtttgttactcagagtatcttttagaaaaggtaaacaaaatgattatttgctagagtggctcactgatgccaagttattgctttggtaactacattttgggccctgtgcttcttggttataaggaaccacagggaccccagtttgatttcccagtctcttctagaaggagggatatccggtaatcaaatgaagcaggggccagggcttcaggggtcctgtctgtgacacctgtaaaaataaacctctcctgccaggctaaattcccggggccaacttactgtcacccccaagacttcagggggccccgacaacttgccctactggaatttatgttgtaaaatggtaaaagaaggtaacctaaattatcttttccataagatagccatgacctaacccatatctttcccccagtctttaatcatttcttcatgtttgaaatgccaactttatgagaagtaaatccaccaggtttgcagatgtctgtctctatggttt

SEQ ID NO: 2695 - DNA, 53 bp, Homo sapiens
gtttatgaaacctccaaagcctgatatcattgtaggcataaagctttgtttaa

SEQ ID NO: 2696 - DNA, 24 bp, Homo sapiens
gcgtgagccaccacgcctggcttg

SEQ ID NO: 2697 - DNA, 290 bp, Homo sapiens
tgtttaattttttaatggatgtaatttaagggttagattattttctatcccaatttgtatgaattttggtaatgtgtatttgctttatcaagatatacagtttatttcaaattacaaggtatgttgttataaatttattgtgtgtgtacacatatacatgcatacacatacacaaatgtttatttacattataattttaaattatctgtgatggtaaatattactcatttttgtttctaaaatgtgtgcgttatatcttaatcagactctaaatagttgcccgtatcagc

SEQ ID NO: 2698 - DNA, 1417 bp, Homo sapiens
agcagcaatatttttaaagagataactaactttatttaattgtgcctattttttcctattgcaataatttattcaaatcttatttttttacattctttcttggctctacttggataattttttctcatctcttagagtatgaagatatttcccttaattttagtcatttgcattaaagttaagaatctctgaataaaactttggctattctcatggatatttggtatttaatgttctcattgtcttaatatttaggtatttaggttataatttcagatgtgaacaatgttttaattcaagacatcatcagaatacctttaaattcatgttgaatagattttgcaagtgttatatcttctgctgtaaaatgcattgcatatttgtcagtgaatgtggcttccttaagttggtctctggggactctggcacagtgttttttgcaagttgtggatttgtccattctgatcttggttgcagaacaagaagatgaggagccttactgtcttggtttaatcaagcacaggtggctttagtacatggagtcatatagcacagaaactcaaaccatgggcaaaaaccaaacagccagtcagagagatcataaacatgttttgagtcagtgaaattttaagtagtgaacagagcattgaaaatgtttcgtatggtctttattgaatatggaggacataccagataactttagtcaaagtctaggagaaaactatagcagatagtaccaggctcctacaatttaaaatttaacataataacccctcatactctactttccaatcctagcttggtgtaactagggcagcagagcaactttcagcagagggaaaacacccgttgtgattctgtcacttcccttagcagtgaaagccctggtgagaaacacatgtggttgatcacattagggaaacggtgggctcagttatgaacaagctggggaaggttgctttaaatgggggtggtctttatatttaaaatacattaaaatcactagtacaaatcaaaaacgatgctagtcgtaatataatccttaatgaggaacggatgttttaaaatgatatatgtcaagcatctagccttcctgctcaacctacatcccaactcaggtaacgtttattggctgccactgttccttcatctccaccatgaatcattcttctgctgtaacacaaagatgtgcatttgtttgtcttgctctgttttgtttctaacctttaggattctaagtctcaactctttgacgtggctttcaaaaccttccataatttgcactgactctcctgattaatttatttcttatgtttttctaataccatgacttgactcctggtaccccagtctcttcatgatccctggtgctgaaatgcttcagatatttccatgcctgaaatttctgcttccatct

SEQ ID NO: 2699 - DNA, 907 bp, Homo sapiens
tggtccaagctatgctaagtgggaagttacgtctctgggagagacaaatagaacaaatgactcatttactgggcctcctgcttttcttcactcaagggttccttagaaaaatgtacctgtctgagtggaagtgactggacatgtgacagttgaataaagcacagagcatgaatggaacactacaccccaccaggcccggcctgttgcctgcaggaggagctgacttggagcagggttctttggcagcagggcaatgctagagcacaggaaacttggcttcctcccagcacatccctggcagaaaactcactgtgagaaaagaggggaggaattcaaagctgaatccaaatcaagttgccagagcccttcggctaagatgtgggaggtcctgggaaagaaaccagggactttaatatcaaaaggaaaattggctagaagaaatgacagagccattggaaatgaaactgaaggaatctcagcttgggaccaatctactggcagggaccacccttcccactgtggcttgctgacatcaaacatggagacaatgaaaggagtggaccatcacaaaaccacacatttaacaaattgtgccaggaacagtagataaatagtctataattactttgccgtttgaaattatatttctataggcccatcctaagttaatataataaatatttctctaaatacttcatgaatgtctcagttacatcctaggacaaattatcttccccaggtaactgcttcaggcaattcacacaccatgatctgttcttttccacactgtttcttcatctcgtctcaccttgattccccacttacctcaatgctactattaaaatcaaatgttaagcctttgaagaagtcttcctcacttatatcagtgaactttaatgcagaaatc

SEQ ID NO: 2700 - DNA, 134 bp, Homo sapiens
gaaattgttcatttcctccaagtaatgcaatgccgaaatcctagggaattctttcacccattgacctacaaatagtgagttacttttttggatctgacattgcactcataagttttataccctatttggcattt

SEQ ID NO: 2701 - DNA, 183 bp, Homo sapiens
tatttttctaagtatatcctgtgaatagactccccagctagacattgaaatagaagctgtagactttctttttctttatacttcaaaatgtacagcacctagaagatgcttgatgtggacttattttatattattatcagctaattggggtagtctgggagaatggatcaacaagtattttta

SEQ ID NO: 2702 - DNA, 2729 bp, Homo sapiens
gctctctcaagggatatgacataaatcccaggggtaccccaagtggtaaggattctccttccattaaaagtctctttccagaatatttgatgttctctaaagagatacataaatgagagatagatagataactagccgtataaaaaggaatatctatttgctgatgctaattactctttcctcaaattcctaccactttacccatattctatctgtatttctttgaattattccgtgaatgtttgttttatttctttctttagcaagctttctgaaaaccagcttttctttgctttccatcatctcttccccacctgtcatgatattaggctcaatacatgctggtttacttatcttgaaatacttcttagaggggacatccagattgcattcatgagcttacttcaacatgcttgctttaaatcaccaatatctaccaccacgttaagaaacttacgtgttatgcggccagagccatctgatccatggtgccttcaacttttgttagactctggatttctcaatataataactagaggtagtgtcacaaagtccttacgttactctctataactattcatttcattttaatgtatgttatgtttgttaaatttttgaaggtataagctttagatgggtctgcaattattacagatttttcttgcataggatgaggagagtttcctatgcattgtcaaagccaaaaaatggagtattccctgtgccaataaacacatttctggtaaataataatgaaaaaatatgacattgatcttcggccacaatactgaactaaatgaaatatgtcaggggtccataaatcttgaacctaggaagatcttttgttcttcagagaaatgtaaggtggcacccacaatacgaaggcaggaagtgaaggctgacaaggaaggaaccagagatgctgagacaccataccagcctctggcccaaaggttcagttaccacaggattaaaacatgagctttgaagctcggctgcctatgggtaattgtggtctttcttgtattatttggtattcagtcaagttgtatttatgttttttctcctttctaacagtgacactcaccttaactgtactaggaacacagtacggggtgcatgtctctgctgggcctgaagttttaaagcaaaacagtcttcctgaagaatgttcgagacagtggcagcagaaatcacaatgaggggaccctaaagagaaagtagaaccaaaagagaaggcttgttgctgtttactcagaccctcctgcatacctagactgctccttgatcaaatcttggagaagaattgtgtatgtttggtgagggaaacaccaaaccatttatggaaccttctgctgccttttaaacaaagtcagacgaagtataatataaaactgataatagaagcatagcatgctcttaaagttttataattcagttttgtgtgtatgtaaaccttgtgggggtggtttgctgtagcaggctctcagcttgcctccctcccttctggcactctcttctactctttcagcaaacagttgatgcagtcatctccattaacaaggcctttgtcatgtcataaactgccaaagtcataaacttttatttggctttgttttctaccacttcacttttaaaatcttttaagagacaccttgggtctttcctttcttcccatttatcagttgcttcccagctccttattcttgcttctatttttgtaattacatatgaatgccttctctcctctactctggctttttgaactttatgcatcaacaaaaactgcaaaaatttacacttttttgaagatgctgatgactctacagtcttcccttctcagtaccattcttataatcatggatgctaaagcactggtgtcataatatcattatgtcaggttgaattctttaattacaagaagattgatggctgccccaagaagaggctttgatttatgtgccttttgtatattcctcagaccgtaccaaagcattaatatacagcagaggtcctctcagtgttctctgaaataatctgcttttctccatctccaggaaggcaatgggctattaagattatgtgtgttagacctaactctgacatggatctaaaagcatttgtttgatgaggaaagatcagtcagcctgagccctcacatccactggatccaaatctctaatttttagtgacacagacttctgaatatattacagactaatgaagcccttgatttcctaaattttcaaaaagctgaatgcttcatgcatcggtatagagcaaaaatttccatgccattccagatcattgggagtaaggctaatatgagcttctagcattccacaccttgtattcttgtgtctgtataatctttattgggcaaagatttatctccaatgagcaggtctacaaaaccttgcacagactgttcttttatttttaattgtagtaaagaatccagagcttgagagcccctggtatagttcaatatcatcccattattccaaatacttcagaaacctcaaaacctctgatattctcagaagaataattgaccaagagacaaatgaaggcaggctttaactacctgtggtaagaaatcacatcaatgataacaaaacaactgaaggttgttatagacataattcagcctctcctggtaaactaaaaagagaactgcatttcctctgaaaagaagaagttctaccagtgtcacagggaagtcctcg

SEQ ID NO: 2703 - DNA, 181 bp, Homo sapiens
gattctctcatctcatttgtaaaacaaagaaacttgacccaaatgtactttgtttttcttttaattctaccattctttatttctatcatatgctaattattctgctttcttccacccactgccaccagatgcattttaaaagttattttttgttctgctgctttgtgttccaagagacaaa

SEQ ID NO: 2704 - DNA, 365 bp, Homo sapiens
tcatatatgattagataacattaataatacttttaaaggaaaaactatccaagtattatgttataaaatatttgaatggaatagataattgagagtctcatattatttccctaataatgactgaatcagtgaactatacaggagtcaagagacagtcctttttctttctttccctggcattcagataggcctctgctagtaaggaattggtgggcagggggtgggggtggagtagcaaatataatgtaagatattcccataaaataagtggcatttgataaacaatactatttgctaatacttctacataaagtggtgtgttagttttctaccactgatgtaaaaaattaccacaaacttggcaa

SEQ ID NO: 2705 - DNA, 37 bp, Homo sapiens
gtttgtttttgttttttctgtcttcagaggagacatt

SEQ ID NO: 2706 - DNA, 558 bp, Homo sapiens
tacacataagtgaccttttaacctgttatctgagttttcttctctcttgattaatgtaaatctagtttgaagatttagacaaagaagggtcaaaattgaacatatcgtagaagtataaaaatgaatggaactagagtacgtgaaactatgtcaacagctaaaacatacactccaatcaagcacataaaagaagccactgtgaaaacttcaggataaaggttatatgcaatggttttcaccaagcgtaatgactagaattatagtgttaagattagttggaaaaatttaatggccatatatatatataagcttctcctatattcagctggctggaacctcaggacaatagcactggaaataaaagaaagaataaaaaagacacgtttctttaaatttcttatgtttatttattaaaaatcttctgtgcaaattgggatgtaagtgtatttctgtatatcccacattaactactgctctcactaattatttggtaaattagttgtctcccacacctggctaatcatcaaaatcacccaagcagcttcatgagctcttgag

SEQ ID NO: 2707 - DNA, 100 bp, Homo sapiens
aatcagcttaaaagtgggtttttcccagagtctcctaaagagatcccaaacagtcacaacctttattttagtcttgtgaagtctgtcacagagaactcaa

SEQ ID NO: 2708 - DNA, 1572 bp, Homo sapiens
gacctgtgcttcactaagaatttatattttatgttaggatatgaaaatgcccaacaaattttttaaatttagttatcatctttgattcagtagaccactcgctctgatatgagctgccaatcaatgagaaaaatttagtctccatacaacagctgaatatagtactggatgtaaacatggggaagactagatattttagctttaagaatattatttttggttaagaagagaaaactcaagtacataaaaaattatcaagtattatctgacaatataaaaatattgggaaaaacttctatgtaagtgttgagataggttggctcttaaatgaggtatagatgtcacacaggcaatggaaagggaggataccgtgttagagaaaaaaagcacaaacataaatcagagctgaatgtagccttcagtatgtcgtctcacctccaatggaagtgaaagtatcttttgattcatatcctagagaaattatcccatcaagatctcttctggaaaatccctggcagattatcaaactagaaatatgctttttctaatattttcaacttgtggctgtttagaaaaatgagtgtgtgggcacatgtgtgtgttgatgtgagattatgtgttcaagattatgctagtctcactgggaaggtggattggcatggtaagaaagccctagggaaatggatgtggtgtttcagcagctatttattattagtgataaaacattgtatgaaaaccccttcctgcctttttaaatcagaccaaaagaaaacaaagtccatatacaagaaggaattaatttttcaaagctaattcttaaatacataattttgaacctgagaggatggtggggaggtcgaacattttaaatgtcatctcattttactattaacaggagggaagttttagagcttaggagtcatgtttttaagcattcacagatatagaaaaaaatatatataactttaaaaagactttgctgtttgaatattgaatcgttttggtgcctcactgctgctttaaaaattccatgtgggctgtatactgctaagagattagtcacttcagtggagaatcttagaacttcctgttcagggcacctggggatgagaaaggagaccatggtagatgatacttttcttatctgactaataagagtgggatcagaggaatgctggaaaaatatttgaaactgtagaccatgggtagagaaaagacttgaaggaaaattatcttaggacttcaatactccaaaaaatcatgatcaacttcatatgtacagtacattttcagttcatccggttccctgtgacttcaaagacatccctcaagtctaagctaccatcatcaatttattacttgcttagactgacatgatactggtccctgaattcattccatcctccttcaagccatttcctaatagcagtcaggaatattactgaccccacttcccatctagattacgtcttctagtgtattcttggaagtacctatatctttcctttacctctcttatcacagtttttaattatacattcatctgagtcattatctaatatttgccaaaaa

SEQ ID NO: 2709 - DNA, 291 bp, Homo sapiens
cataaatttaaaaaatgagggcaggaatgaacaaaaacaaaagaagtgggctgtcatctattaatgaaaatatagtctaattgagggccgtaggagtggacactgtcctggtgtagtgctcaactgaaaattaagaatggagaaaaatccattgaaaaatgtggatggtgaaacattaaaagaaaaaccagggatatgactgggctgttagtgttaatcaattggctctcatgcccaccttttatctataaaatcaccaaattcactctgagaaatatgtaaaccaatgca

SEQ ID NO: 2710 - DNA, 321 bp, Homo sapiens
ttgttctccatgttttcagggcctgacctcgttgctgctgtcaagcagagaaggtatgaagggatttctaaaccaaggtggggagagaagggcatgtgaatgcaacccatggctcactccctgggaaagccaggagcccagtcacctccagtctccctgtgtgagaggaggggctcttccagcaatgcctggctgaagcctctgaagagcacctgcaggaggcggtttccacaaggaagagccggcctcatcttgtgcagatcaatttgggagacggggtggccggtgctggtctgtgccttgcaggaggcacccatttct

SEQ ID NO: 2711 - DNA, 402 bp, Homo sapiens
ctgaatggcgtttcaaagttgggaaaagtagtaattagctttcaaaagtagtcacaaaaattaaaatgggctctgaactgagaggagagcttggttagaaataagtagagaaactgctgtggatatgagaaagcaaggtcagggtggcagactaaggaccatgggcaggagtagagggcacgcagggctcccaggcactcgaagccatgctgtagagcagagtgggaggccgggttacttggtccctgctggacaggccaggctctgtcagataggcagtggggagcgggtaggtgaagacagaatggtacttgcacagaatagtagtggggtggggggtggcattgaccaatcacgagcacacattcagatgctttctgtccacacttgtagtcccagcta

SEQ ID NO: 2712 - DNA, 239 bp, Homo sapiens
gaggagcaagtttgaaccgggggtggagtttgagacttttctttcagacatatgactgattcgacttctaagaagtcacatctggcaccatctctgcagagactgttgtctgcatgcaggagtgctggctctgatctggccacatcctgcctttttcattcaaccttgtaacagactttcatgtgattagtaaaacgaatgggctttaagtcacatatccttagtgcttggaaacagta

SEQ ID NO: 2713 - DNA, 36 bp, Homo sapiens
ggaaacagtatctcttaaataaattaacaaaaagcc

SEQ ID NO: 2714 - DNA, 510 bp, Homo sapiens
agccaaagaaggtggactcagcagctgagtaaaccagtgcctgtctttgcctgccacctccacccccagctcctccacctgcactggcagtgcaggagcgccgtcattcactgctggctccccttagccgcctttatgccattgacccaggcaggcctcctcccctcctagaaccagggcctggagatgctggagcctagcactagtgtgtaccctacaggtgggctgggcaggaagccaagcaatcactgccctgagctcttggttcttgcaggaaacacagcagtggagagcaagacaccagcacgctgccctcaccacctctcctcaccacggtggaggatgtgaaccaggtattcaggcaggctctgtgggcacagacttgggctagcttccacagctgcagttttcagagggcctcaaagtaatgagggatcttctttgtggtgattaattttgtgtaaatgattagccacctcagctgactcagagccacaggaagctctacgg

SEQ ID NO: 2715 - DNA, 447 bp, Homo sapiens
ggacaggggtgtgggagtgagtggggctctcacccggcttcctaggagggaataagggccaggcatctggggaggtgggaaatgatgatacattgcccgaaatgccactaagaactctcttttgtttctcaggataacaaaaccaaaacgtggccacccaaagcaccctggcagcacccttccccgcttcccagcacgctgcccagccccagcgcaccactctatgcagtcaccagccctggcagccagtggaacgacaccatgcagatgctgcagtccccagtgtgggccgcaaccaacgactgcagtgccgctgccttctcctatgtgcagaccccaccccagcccccacccccaccagcacacaaggcagcacccaagggcttcaaggccttccctgggaagggtgagcgcaggccagcctatctgccccagtactgaccccag

SEQ ID NO: 2716 - DNA, 206 bp, Homo sapiens
cagagctgtggggatgagtgtccccaccccagggccacttagctgacaccagcccctcagaggaccagtgcgccccatcccagggagggttccttggggacaagggtggttggcagctccaagcctttaaacctggcttctgaaacgatggcatcagagccctggagagccagctggagacacaggcgtctggccttcaggggctt

SEQ ID NO: 2717 - DNA, 928 bp, Homo sapiens
agctcttgggtttttagtcctgctgtgtgttgggaagacatcaggcctgaaagctgagggcataactgaccattttttggaaaccctctcctccctcctccacaccttgagtgatgaccacaccaatcactgtattttatagctttttttttcatgtaggtttttagttaaaacatctcctgcctaaaatgcattgaatattttaagataacagatatactggctggaggtttgtttaacactatctatatttaagcttatacaaaatgggcaaaatatagaatatttgtgattggaagcagtcacctggggtttctgggggtggacagttcctcgccacccagcagcaccctgggactgcggcctttcccagctttattgaagcagaatggtggaacttgtgccggaggtacactgctgaaggtgcgtggcggtggaccagccagctgctgtccatgtgcagagcaaggctgcacctgctgcccttcgatccttccacacatggccaggacactgccacaatcctcggggtgtggtcaaggggcactcagagacacctgcactagaaattgcattgacattgtgagctggctcagaagacaaaccaattaagatgtagatagaaattaatttaaggtcttttcttaaaaaaaaaatccacctcattttcagttaacatgtgccattaaatagataacatcctgtggatttagggatattttccagccagaatggatccagaagaattgaatggtgcttaaattgagaaataataataaatatatctatatagaatagacatatcccactgtatattaattgaggttacagaaagttctttatataaaacttatttaaatttttcatatttcatctttgaaaaagtctgagaaaaatccataatattttctggtatgaaagtttgaca

SEQ ID NO: 2718 - DNA, 158 bp, Homo sapiens
ttaaatcattaaaccattttaatatatgttaactactaataaatggtttattctttctaactccatataagcttttccagcaaagattgtaataacacatttatgttctcgtttttctacagatataagtaaatttatatataaaaataccaaaaaga

SEQ ID NO: 2719 - DNA, 1317 bp, Homo sapiens
aacacacacactaatttgagaggacccgtagggtgtctgagcccagccacctgagtttttagtactgtgttgtcaggctcttcccaggcctcaggtgttgtcttttgtgctgtgtggggatgcattgctgcctgtatttatgatcttttgccgtggttctgagcattcacctcaccatgtttacaaagaactgttttgtatatagacattttcaggcacgtgctttgcaccaaccctgcgtggctcttgtctgtgttagctgtcacggtgtgcacactaatctctgttaaagttgtctatggctgttctacttgtaagatagttttctatttccttcagtaatgtgtccacagtaccctgtatttcgagttccattatactgaagtactcatgttttaatagtgcctctccaaaggcctcaccttggacagaggtcaatccttgatgctccagcacaggtgacgtcactaattgtcactttccagtttgtttttctctattaaggaagacattttctaattgcatctccatgggctgtgagactgtgtgaagccgtttgtgtggtctccatgtaggtgctgtgttcccggcaccgccttgctctgaacactggtaattccaggtgctgcgcttggcagaggggtctcgccaaagcgcatgtgtgtgcatgtgtgaacgtgtgtgtcctttgcatggttgggcgtgggtgccttgctagggcatcagcaggacattgtgtgtatagttacaatgcttccaaactggaactctacattttgtatcttttaaagctcctataagtaaaataactattggctttattaaaaatatacatttaataatactttgtatccttgtttaaaatgaactgcagaggacattatgtcaaaagccctgcctgactcattgctttgaaaagctgcatactgagttggtttttaggtcagcctgtcctctgattctagcaaggggaagaccacttgggatattacggtgagctgaagtggatgggcaggagggagaacaagcagctacgcctcccctattggcttccctaaggcccaagctggtttaggcccctgtgcagggggagccagtgcagtagtgaaggagacgtcctctgcaagggtgcaagctctctgggttggggtctaccaacacccatgttccaccaaatgtggatgctgtgacttgcccagccagcttgtccaatgacgagacccaagaatgagggcttgttttaccctcttcccaaaccagggacccaatctatggcagagatactgtgccttacagggataagaaggacctgtctct

SEQ ID NO: 2720 - DNA, 364 bp, Homo sapiens
caaaaacaggacctgtctcactggatgatgccatcgtgttaagcagaagaaagatagtatcatgagacccacaaatggagggcaggtcacaggagcatttcagctcattttcatttacagaaagacagcacctcagtggaaccttttttgacgacctgaagaaaatggagtaatgtgggcattaatatataagctgctggtgtaggaaccactcttctttctgccaaggtgccctgaagttgagcatggggaccaagtcccagagccttccaaatgcacctcaggacaaagttgctcggtaacggccatgttgcctgagagtgctcaagaatacactggaagttcatattaaaaagctagcagg

SEQ ID NO: 2721 - DNA, 870 bp, Homo sapiens
gcccatattttattccagagtgttcccatttaacacaagcacccagttctcttgactagttctgattcacagcagtgctggaggccagagggcagaagtcccgcagctctggctgtgtgcaaatgagtggggagggaagctgagcagatgctacacctgagctactactgcaagggcttcacaggccttggcccatctgagaaatgggggaggatgcgcaggcatcttgaggtacttgggaggcttgtgaccttcctctcccacctgggggctccttggatagggggcttccagtttggaggctgagatgctgcatgccaaccatgcggctgtgaggggatggccttttgtgcactgtgtggccactgctgtgacctgcctcctgttgtggagacaggaaataaaccttcccaatgatcagcttctctactgcccaaaagcatgtatgtggacagcatgactggctacctcccagcgacaggtacccaggagtctgaggcacctccaagggtagactctggaaataacacatgcacctagccttacagcacaggggtgagctcctgggcccaggcctgtgtgtgtcagtgaggggactggatgtggcttgtactggaatattgacttggagatgtgggcctaggtgagggagaaggattgtttcaggcgtgtcacattcatttcaacattcacgaatgtcatataagggctaggcccttgctaggagccaggactgcaaagatacagtccctgcctttaaaactcagtattttaggggagacaacccatctttcccatccttgataagagaaccaccatccaccagcaacccagttgctcaggctgaaatcccagaagatattcttcgtt

SEQ ID NO: 2722 - DNA, 83 bp, Homo sapiens
tgccgtgtgtcctccaacttgcctgttgctcccaaggctgcttgggcctctccatcggttttctggggtcagagcccatcttc

SEQ ID NO: 2723 - DNA, 95 bp, Homo sapiens
tgaccaccacagtgcaacttgagacagatgaaaggacgagttgctggggccagaacttacgaattctaatactgagcaaaaagacagaactagag

SEQ ID NO: 2724 - DNA, 896 bp, Homo sapiens
caaccagacgaaaacattctcgcgttgggctaaaagaatactattaaatacatcatctgggctgttccaggactgggaggggattagcactacggtggagctgcggataggcccaagcaggcctcaaataaatgtaaagctttttattctcgtggaaacagctatgtacaatggggaaaatgtttttaagcatctagcaaaggattcacggggctctggtaatgaagccccgaaacgacaagactggatcgcgcagggtagggccaacaccagggacaaacccccggcctcttgggggcgcggtgagtaggtggcctctccaagcaccactcccgatgtgcgcatgagcgcagccgcccctacgcagcgcgtgcgcacgtgcactcaccacgtccatcccagacgtgcggacccgggtgtctgcaaggttcagtctccacaccccagcgcccgaccctgcgcggggacatgcgcacaagcgcgcgtcctgaccacccggacgtgctggcccacacgcacacgcgtgcgcattacccccgccccatccgcgcctgcgctcaaccccgcctacacctgctccgtggcctccccggaggcgatgagccaaccccggtagctccagaggcgtggtcccctcgccttcgccggtcaacatgactcagcatcctcggtgggctcgcctcctcccccggaacagctgtctaaaatccatgggcgtggaaacgccacgccacgccccgctcccgacttcttcagctcaggccccagaactgaccaccccaccagtcctctgccccagtccctctgccttcactcccatggccacctgtgctccagggcctgcctgacccctgtccagcggccctgaagtaaggtctgtgatgtctaaatgccga

SEQ ID NO: 2725 - DNA, 312 bp, Homo sapiens
ctcttgtttggaactgtgcccgccacagcctgcagtaagtgctagcttcatcaatactcagtggcagtcaattgcttttccagggctgccttatgcttgaaattaaatctttgctatccagagttaggactgtccccggacttcctaacttgcctctgctgtcaggtgtaccctctggtccgctcctctctcagggccacatcatcttgctgggggcacgtgaaggtgtccggctctgcagcatgttctcttggaatttctgggctaggtttcctttcgattctccttggtcagtccctggcctgggggcat

SEQ ID NO: 2726 - DNA, 100 bp, Homo sapiens
caaaacaagttttagacttttagacattttcccactaatccttgtaattggttggtttgcttgctttcagatgattctttttgttaattctattttttaa

SEQ ID NO: 2727 - DNA, 204 bp, Homo sapiens
tccattgaaaaaatctgggatgctctgtgattccagtgagtttgggattgcatccttttacttttctaaaagccaagtcctgaaacttgagggaattgatttctaatgcagaacctctcatgacccacactcagacttctaagagatcaggacagtgagaacctgcccaaaaatcacatttcacttttttattttttattttct

SEQ ID NO: 2728 - DNA, 357 bp, Homo sapiens
cacatttcactttttcgttctttcatttgtgtgtgccccgtggtcttaggtgccttgggagtgtccaggtgactgggtcaccgtcctcatccttggagtgggtgtggctgacttgagcacccgctggggctgttactttgaagtacagaagcctcggagaacaaggagagacttcctgtaactatttcaagacatggatttcaaacacaggaagcagtttcagaaagaaatacgagagagtaaagagtggttaatgttgaggctgggtagcagcgacttgatctgtgctctccgagagagcgtgccaggttctgcagtgtggctgctctctgctcagctcttttttttttttaatta

SEQ ID NO: 2729 - DNA, 69 bp, Homo sapiens
tggagcccaggcttggggttccatagattgagggagaagtaggagtgtctctgtcagttaacttctatc

SEQ ID NO: 2730 - DNA, 187 bp, Homo sapiens
ttgccaataccactgggataaatgtcagtggataaaagactgtgatgattatggttcttgttcatggtcttgatagagtagaataatgttctttaaaagttcacaggaaccagtttttttttttggcttgtgtgaaataatatgcgtaaatggtcataacaaaagtagccaacattttatttattta

SEQ ID NO: 2731 - DNA, 588 bp, Homo sapiens
tagatcagtcagtccctgctgaatggggaattgaggaagaggttatttgatttatctaaggtatacagatgtttcttttccttgcacccacctttggaaactgtaagtactcaccagataatgactctgggcaaattgctgctaagcgttgatgagagtaccaaggcatgggagatctgtcctagacctagacaggtttgatacacttggagaagatggacttggtgcctgcctgtgttcaagtcccagatgagggttacggaaggcaagaaccacaactcttatgggggagagtgtgattggggtctgaggaggcttccttccctgagagggtgaccagaattagctgctttggatggtcggtgttgtagaacttcaacagtcgaggttgggagggattgtggtcttgaagaggcttataactctgttgcatgtccatcggtgctggggaacattgagaggctaagtttgcagaggctgaaggtcactaaccaggtgctttgttgatcctggaaggctgggatcaaatgctcatacccagctggttcaaccctgacatagaagtactgtgtttggcctgcacagagt

SEQ ID NO: 2732 - DNA, 279 bp, Homo sapiens
aaatataaaggatttgtctccaggttgtcaaagtccttcccttacctgttaccacctctcttggctcatttacattatctggcccctcctgaaagtttttgcatttgcagccctttgtaaatatggaaaatggagccacgtgggcttgtcaggctgtgggaaaaacagtgtatctgcacacactaccttgtggtattcgtatccttgggagatctgcaaagattctacattcctaagtcgtcctggagaaatttacttttagttgattttagtccaaag

SEQ ID NO: 2733 - DNA, 92 bp, Homo sapiens
gcctgaaacactgacttggggcttcttaggttataactattgctttacctcaagataaggttctaagagtgaccttaattactagctacagg

SEQ ID NO: 2734 - DNA, 286 bp, Homo sapiens
aagccacagatttttaataacctcatgaatacagacttgaaaggagtgccacgtgaaagccagtgtcttagtatatatttttttagtgatttagtgtttgttatgtgtgtatagttatgagcaatatcatggacagatgcaacttttggcctttataggtgggacccagaaggctgggtatctggtttggccttgataatttgttggacagagaaggttttaaagggtttgagagggtagcattagtgaaactagtgaaactaggtggataccaagctagcattcc

SEQ ID NO: 2735 - DNA, 278 bp, Homo sapiens
agcattccttttcataagctctttcgacttcctttcttccttggtcattaatgccaccaggcatgtgattagaaggccccttccctgccttttggattgtggagctgtagctctgagtctgcttcccgctggggctggtcggctcttggcctgtgtatcccctgctctttggggctgttggtttcaggaaaggcagcaaactgcagcaaaagcagaggtggggacagtgagggaaaatggatgatttagctttgccggccaccaggcagtagctgtac

SEQ ID NO: 2736 - DNA, 306 bp, Homo sapiens
cctctagtactttattgaaactttcaattattttttatttctgcggctggtaaaggaatagtgaaaggctgtctagaactgtgattctggtttggtctaacaagactttgatgatgaactttgaaattcgttttgataaaattgtcctggtggtgtcacctgatcctcatctctggatgctttttgactgcaggttataaagagggtcctttctcctgggatgagacttgatctcctctgttgtgtttggtgtcttcatcaggctgtggggaagctagataagctgtttatttctgtttttaaatt

SEQ ID NO: 2737 - DNA, 27 bp, Homo sapiens
atgcttcagtttttgtggctgtgagtt

SEQ ID NO: 2738 - DNA, 1972 bp, Homo sapiens
cttctgccgaggtcgttctcagtggctgtacctttgattttgttgctttactttccatgctgctctgtggccctgacctgtaaatacaggtttttgcaacttgcattcattgacagttaaatggaattcacttgtcatagatgtgaatacagtacactggaatgaagatgccccatggttaaagtacacacaggactatgagtgttataacttttattggtcttggctagatagagtcctggcctaaggactgagacagatttcttcatagcctcttaatgggaatcagagaccctcagtggggctcatggagggtcagagcactttccattgggcttccaaagagttccattgagccctttccagggtcctttctattgaccccctcatgcaatcagacctggacttgattgtccagtcccttggtaaggactcagtttatgattgtcagctaccttgctaggctgtaattgtctcaggcttccctagttttttctccttaatcctttttcagtccctgagaagcttctacatgtttcaaggggtagtctgctctttctgggagctgttaccgtcaaggttgctataaacaaatccatgttgtttatctgaggctgaagaaaattgacattaaactgatgtggtttttgtctgtgttggggtttgatcaaagaccacatctccttttgggttagaagtctgcctgatattttattgccatactaatgccaagcatctcaccctttttaatgtcttgtgcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgtatgtgtttgacatgaggatattttctttccattttacatagaagggttggtgaactctgtgctgatgcttgttgtattccagtgttgcattcatcaaaagacttcatctttaacccctcaaagtcagccagagggcatctctgcccagctttagcttctgcctgaggtctgtgagcttttgaagaaggaataggacaaggaggtggctggcttgcccagcatctgtagtatgtggccactgataggtgatgagtgccacaaactgctcttagccagaagcaacccatgtcctcactccaccccacctcctattgcttggatccctcagcttcagttgctgcctccattttatcagggcccggggcatgcccggaaaagcaggcacatgctccctttttcacggcgtgcccacatatcacgtcatgtctgggtatgcctttctcctccctcctaggagtttgcctggttctcactccctcaaagtactctatgatcaagtttctttggatccatgtttattgcacagtcaaatctgttgatattaatcacgacatgttagttgatcagggaagactcatttttttctagatttaggattgttatccggctgtgtccactgtttaatggtgatgtttgtaattctgtgtgcctagcaaggtctgtaggatcaaactacaaacttctggtagtatgtgtagcactatgcaaatacaaggtagtaataatgctgttactgtcactgtccttgagacatatcttgtgaatttcaggggattaagacagatgactgaaaagttgataatctgttgaataaatctttaatttagagcttgctctgtgctatgtaatgaaaaaaagacaacgaagatatagggggtccttggtttagtctgagtattattttagtggagccacatcttaagtaagttcagctatagagatttagttaatagaaataagatggtggttgaaagagaagtctgattttacagcagaatagtatagtaatttcctgctctgagtccatgccagaatgccctgtagtgagaatgagg

SEQ ID NO: 2739 - DNA, 188 bp, Homo sapiens
tgtgcactcaatttttctgccactgatgttgggtcagtcttgctgttgtgaatattttgggtaaagcatggctcctaagtataacaaaaggaaggcataaaaggaaagctggctgcatagacagtttattgagagaagatgttagagtactgaactttacaggggacttcaggaatttttgagggaaa

SEQ ID NO: 2740 - DNA, 1470 bp, Homo sapiens
gagggtaaatttgactgtgctcagtttttgtctttggtgagatgcaattctactacccaagaaataaaatagcagtcacctggcctgtatagagccaggaagaaccattgtttttaagaggctgtaagtatgaggaaagtgaactcacagtagaaatggatctttcagtggctttcccctctcattttcctatttcaggaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacacctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctg

SEQ ID NO: 2741 - DNA, 573 bp, Homo sapiens
cttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagtatcatgtcttctgaaatttgtcttgccctgggtatatgctgttaggttcaagtgatgggaaaccagtgcttctttcttcagtgaggactgatcttttcacatcctttactgatttttcagatgtgcttatttcttc

SEQ ID NO: 2742 - DNA, 233 bp, Homo sapiens
agatgtgcttatttctaagctgacttcttttttcttcattcacattatattgtacagcctcctgctttttaaaattctcgttgctgtaagaggtttttcctctcggaagtccaaggcctggcctatctgctgtgaagccttttcagggcatttccttctgagaaatatagcaggacagtgcttggcagatgactgtggggagattttttttttttttttttctgaaggtgtga

SEQ ID NO: 2743 - DNA, 86 bp, Homo sapiens
ctgaaagtatgtttcaaagtcagttaacatgatcttaatctataaaataatctaaaattgtcaccatttttttctcccttataaaa

SEQ ID NO: 2744 - DNA, 100 bp, Homo sapiens
gctcagggtgaattatcggccccatggaggcagggtggcagtatttctcaaaactgcaaatgcacacgccctgggaccaccctctgggggttctgaggct

SEQ ID NO: 2745 - DNA, 1041 bp, Homo sapiens
gattgagagatggggaaacgtgaaggaagagaagacatcctgtgccaccttaggtgtgcacacagactcactggaaggataaatgtaagactactaatggctgttggtggtggggaagccttttttcacagactgccctgtgctattcgatgagtaaactgtatgcgtgctacctgttcaaaaagtgtaaaacagaaatgggagttggggactgagggagaggccctatgttgattacagttttgggaccgagattccagggctaggacacaccggggagtctcgcatggaatccgcaggcagggagggagtttggtggccaaggagggactccaggcccctccagccctgtcgtctctgccccctgagagtgccattcagcagccctgggggagggggtgtctccttgcccactcggaggtctttgcgacttggatccgcctggtggggctgcgtgccagcagccccttccccctcatgccacatcctgccctgagctgaaggaaagaacgggccttctcctcccctgtggtcataaaacgccaggacatggaaggtacctctgaaaacttacaggcacaggtgagaactgagggcagaagtctctcaagcagcaagtccttcagcttcactcggccgtgttgtgacgttccttcccagagttcagaacgctgctgattttccctctccccctttctcccagatgagcagcacactgtgggggcgccttccggatagctctccactggtgctgtgatcgccttccccgctggtctgtgtcccacccacgcccctcctgatgacagatccttcggggggaggcagagcacccgccacgtggcctggagatggccgctccagaaaggtgttcgcagtggagacggggctctcccgcgtgccttggaggatcagatgaggttgtggacgtgggagcactttgtgaactgggcatgggaaagagtgaaggtggaaactctccccacgtcaagtagaattgcattcaggagggcactttgctatgtgccgttctaaagagaatcg

SEQ ID NO: 2746 - DNA, 1633 bp, Homo sapiens
ttacttaatacaaataaagagaagagaacggggccaggtgatcttccatgaagactggctgcccttcacagcagcagcaatgtgttctcctgagacattgccccactcccttcttgccctctgtgctggtcccagtccctctccacctcgtgaacccttgcagcaggctcgccccagctcttctgcctctgcggcccccacttctgaccaccctcagagcctccccagtgctgctgtccagggtcatggcactccctgattcacatcccccagtaattcccattgcttaggaaagaatattcggcttccttgaccacacagtccacctggtgccacctgtctacctctttcctgccccgccccagcccccactgtacctgcggcttccttggctcctctccgttctccccagcaccctgctcttggggtcctctgggccagagcagctctcctctctagtcaggcccagggtgctcacctggtctacacccacctaccgtctctcttttgtgcttgctcccctccagcccccaagggcctcagggctcctccaaggccctgctgaccccagcccctctcccctgccacccccatcccttttgataggcgttctcattctctgaagccttgctcagtcatttggagacttgtgttttctctcctctggctccaagcgagagcagggctgggaggtctagtttaccacagcccacccccgtgcccccacccagcgtaccacggtccccctctccacttcgctgaggccccgcttggttctgctgtggcccccagcttatcgccagctatagtagggcatatatgggtatatttatgctcccctaaacatactcctgttatcctctctggatcttttgttcctgaggtagagaccatgctgttggtcttcagatcacctctgccacctgactgccaactcaggtctcagctcactgctagatacctccacccacagcctgcagtcagggttgggtgactggcatcccttgtgtcccagttgaggcagtgggaacaggaggggtggagccggctgctgttgtgatgatcatgtgctgccttcctgcgttggagtgttccacttgcccattgttggaggcgaggagactgtgccactgaggcacctgtgccagcccccacccgaagaaggacgccatgtgcgtcttctaaccctcctcctcttcccgcctgtaggtcccgcaggctcccgatggcgagattacggcgccctggccatcatcatggcaggcattgcatttggctttcaccagctctacaaggtgagtcacccccagcggctgcaggtgctgtgcccctgccaccctgtggcattcagcaccctttcactggttcccctgcatggaggcactgccgtgctctgccctggagtgtgttggcagtgagaggctgtggtagaggtcggggttcacagctggatccaggcagaccctgccctgctgtggggcttggcaggctctgcccaccttttctccagtgctcagcatataccacccagatctccacttgcaggggcgtcgtgaggtctgtcccttgccagcccatgtcaggcacttacagtagtgcccgcacggggaagccgtgcgagcagttttgagac

SEQ ID NO: 2747 - DNA, 349 bp, Homo sapiens
caccattgttctgccacagcatttaagagcggcggtgagaacctcagtgtcatcagatgtatgggagctgttctttttgctctgtctgttgtgctgccatctatagaaatctaggatttcccaggcttctcaagtcaactttcaggatcccaggttcattgcttgcaacagaactgcaggcatgacgtgaacattgactcccttgtgaaggcccaacttggacgtgaagcaaatgagtctagagtctagaaaatgcaggccagggtaggtgcccagtccagatcttgggaccctgtagagaagcctcttttctttcgaggctgccagctcctccacccctgattggtga

SEQ ID NO: 2748 - DNA, 274 bp, Homo sapiens
ggtgatccgcccacctcggcctcccaaagtgccaggattacaggcttgagccaccgtgcccggctggtgattttcttttttaaacaacctgaatgagcactcagactcgccatggtcactcttagcacatgaaacatggtcagccatggtattccagattcttcatttttgatgtaatacaaaagctaatgacagttgtagcagaatataattttttaagtgtagcatgtattcctggagctggacatttccatgttagaaattgagaaacaag

SEQ ID NO: 2749 - DNA, 27 bp, Homo sapiens
ttgagaaacaaaacatcctgggttggc

SEQ ID NO: 2750 - DNA, 180 bp, Homo sapiens
cacctcttgggacccggttcttctccctctgaactggtgcccccttcaaatcactgactgtatacaagcaccaagaagaatgtgacacgaacgccagagtcctcagatgaatgccctggctgtaatgagcagtaggcactgtcacatggccacccatggagggcctgtggcctgacggga

SEQ ID NO: 2751 - DNA, 100 bp, Homo sapiens
catgaacgatgttatgaccaaaaggtgaaatgctgagcagagttccagaaacactgcaatgagcacaaaggaggttatagaaactttagtgcaaactgtt

SEQ ID NO: 2752 - DNA, 912 bp, Homo sapiens
gttagaggaaagagtccctgctggagccttgctcagcctccaggagaggttgggtgatgatgcagcgtgatcctccttgggggcatcagagcaggaggcaggggtggagcagacagcagggtagcaggcagtgaagctatgagtgcagtgagaaaataagggagagctagtcagaaggcttcagctttctctgtgacgtcagctgctgggagtgtaggggtgatagagctgaaagagatgaagaagagagctcaggagacagaggacaagggaaaaataaaagtatcaccaagtgtgttgagggcctaattcaggttggaaaccagaaattgcagtttcctatctgtaaattaatttgattttctcaagcaacacccagcagcctaaattggggagggcaatttgaatatatcttctggatctattctatttaatcaaatcatcattttcatctctgtaccatttttctttgggctgttatagaatttcttgaagaaaaacactaattcatcaactcccattgctacaatataatttgtgtgctaaacgcagatgtgtagcatctgagtgttggaccctgagccttgtgtaaacagcctgctttgaaatatttctctttatttatggaaattatacatgtgtatcacaaaggatacaaataaccctgaatgataatagagtaacaaatgaaagcctccattatcctccaaccctgcatgcttgtctaatacactcccctccgcagatgtgactgataagtataattctttctccattttctgatatgtctttacaagtatagaaactatgtaatatttaacggcattatgccaagtgcctatagccaacagtactgtactgtatacttaaaatttactaagagggttgatctcttgtattctacacacacac

SEQ ID NO: 2753 - DNA, 109 bp, Homo sapiens
acacatgccaataatgataaagagggtgcaaggaaactttggaggtgatggctatgttatggccttgataatggtgatggtttcacaggtatgtattcctccccaaatt

SEQ ID NO: 2754 - DNA, 62 bp, Homo sapiens
taaataagtacatactattcatattattttacccttgccttttttagtgaacaacatattgg

SEQ ID NO: 2755 - DNA, 376 bp, Homo sapiens
tttttttttaaaaagtgaacaacatattgtaagtagttttctgatttagattattgcttccaatagatgtatactgttctatagtatggaagcaaatatttatttaacaattttcctcatgtaaggatgatgtaattatgttgtttaaaatattacatttatcttgtttataaggttttctatattttgacagtaaatatatatgtgtatatttacaacaatttatacacacacacataataaatacacatacattttctttgcccctgaaaagcatttacattgtgatagagtcctagaattaaaagtgttagatccaggagaatacaacctcccactaaaaatcttctacttctttgcaaactatctataaaat

SEQ ID NO: 2756 - DNA, 44 bp, Homo sapiens
gtatagtaggcccatattcttaaaacatttccagtagtatataa

SEQ ID NO: 2757 - DNA, 250 bp, Homo sapiens
gcaaatctcttcttccagtcagttatttgtcactaacttttataatgtttttcaccatgcagaacattttaaacactcctggttgctgagtttcatgtcattcttctgtctttcttcattctatgattgtaaaaatgtctttctaatatgtgctttaacaaatttattttggtatgtctctgatttttcttttatatggaatataattctgtctcccatctaaggtagtaatctgtcttattattggatc

SEQ ID NO: 2758 - DNA, 500 bp, Homo sapiens
tcaggatcactcagccctgtgtcattcatcaagacaatgaaagaatgaccctgaacatatttggagatctttgggactgccatttccatcacaggtccacaatggcagagccatgaaggcataatggtttaaaaggaggggcccagaacatatgtggggcctttaactcactgcccagtgccacttcaaatctctgctctttgattcaaatgcagcactttttggccacccccggtgtggctccagtgggcccagttgtggtgccagcagcagtggctggccctccagaggatgtgggtagtaaacctttgcagcattcacatggtgctaaatctccaggcactcagaatgcaagaactgtgggaggatggccacctccacattgatttcaaaggatacctcaccacagagagtccccaatagggcaatgtcttatggagccatgggagcagggctgccccaaaaccccagaactgtggagcctccagtgtaaaacgccg

SEQ ID NO: 2759 - DNA, 240 bp, Homo sapiens
tagttggtaaaataaattgaggaaattattactaaacctgtcagggagctattatttctagggtgaaaggaaggggctatactcaggaaaagaagggagggaggaagaagggtatgcttggtgtagcttttgctggggtgttagcaatatatttcttgactgctagggtttgctgtacatatttgttaaaatagtcctgaaagttttatcctcacttctttatatgctgtattttacaat

SEQ ID NO: 2760 - DNA, 700 bp, Homo sapiens
agtagtgggacaaccttcttgtttccaagcagtctgcactggggttggcaggggcagaaatttgctagttgggccagtccccaagcccgtaggtcatgcatgcaggtgggtgccagctgtggtggtagcagcaggttggatggcccatccttaggctcctggaaggagtgctcacatgccgaaggtggtggatggggcagcctggcagaatgcttgggtgagggtggcagcagatgccctgtgaccctgctgctagtgggcagggttgttttcagtggcagcaaccatgggcaggtggttgatgtggagatgcagaggcttttgagcctcatgacaggattcattctgctgagagatggactctcaaaatggaaccttgctgtagctgcttaggatttgccaggggtggtgtgtgcgggacccagcgtgagctcccattctagagcagtagagttgtatggtcttcaggcagcttcctatgttagttttaaggtcctcaagggtcgaggagttatctcatggctaggattgcaagaatctacagtgggaatgtggactgctgggggtctctcacttaccctttctccacactggagagcctctctgggctcccagctggtcatggctgagcaggctgtctcacttctctctttccttgccttaggtgtttctggccacttttctgttgaattcctgtgta

SEQ ID NO: 2761 - DNA, 26 bp, Homo sapiens
actgggtttgaatttttttaaaaaca

SEQ ID NO: 2762 - DNA, 642 bp, Homo sapiens
actgggtttgaatttttttaaggttattggggtgtgtgtctgtgtgtgtgcgtgcacgtgtgcactattgtaaatgtggtcttttcaattacatcctgcaaatggttcttctgtgaattggttttacatcattttatttactgaatccctaatagtttatggtagttctcctctgttttcttcagttgtccaggcatatagtcgtattaaccttctaactattatatgtaaaaccctagttttatatgtaaaacctaagcacagtaacacacattctgatgtaacatgattagtggttgatgcctatcctcttccaaatccactttcttcaaacttttctaggaggcaagggaaaggggtcatggaagagagaaaaaggagagagacagaaatgtgagacaattgcatgacagcgggacaagggctgggtccctacatctcagtgcttgcccagcctaaattttctcaaataggcacgtgcaatagacaggtgatgttttacaatgaggctcttgaagctctcaaaattatcggccaggttacaaagcccatattcaatcaaacatatatttatgctgaggcacacaagtgctaccaggtagtgccagatggcagccatgacccagatgggtatgaattatt

SEQ ID NO: 2763 - DNA, 200 bp, Homo sapiens
gctgtctagccaccactggattcatgagtctaaagagctggtgttgaaaggtatggaaggaagattacagatttgtagagcatctatgcatagtgttaaaatcatgagtgtagctgggactaaagaaggagagactataaaataagaacagtggacagagttaattgtcctgaggtgcaccaacattaaagggttaaaaa

SEQ ID NO: 2764 - DNA, 56 bp, Homo sapiens
ttcaaaaatagcatgcagcaagtccttccatgggattgttggtttaaaaaagtaaa

SEQ ID NO: 2765 - DNA, 200 bp, Homo sapiens
ggtaaaagtgacattgttcaggctccagagcctggaacttaagaggctttgtggcttcccctctcaccctgttggaacccagagaccatgctgtgaagaagcccagtccagccaactatacagaataggccatagaggggagaaacaaagcaccctggaagacaactagcatcagctgccaaacctgcgagtgaggacat

SEQ ID NO: 2766 - DNA, 38 bp, Homo sapiens
ggaaaaatcagtatcaattgtggagagcctccagaaat

SEQ ID NO: 2767 - DNA, 100 bp, Homo sapiens
gaagagcagtggggaaactgtagcaggaggctggagggaggcagccatgctatcaaaaggcagtaccactggccaggctgtcacctgaggcaactcggaa

SEQ ID NO: 2768 - DNA, 39 bp, Homo sapiens
actataaagatacatgcaaactctgtttattgaggcatc

SEQ ID NO: 2769 - DNA, 100 bp, Homo sapiens
catgcagtgcaaattcgggttgtgacatcagcaagctggttctgtgcagaatctagttggccatattgattgcaaccaattttagctagttgtgttatct

SEQ ID NO: 2770 - DNA, 141 bp, Homo sapiens
ctacattcaatgacctcacgtaagaagcagaggtaaattttccagtctgttaactctgcaattaatggaaaactaatggaaaacattttggacagcttattcctccatgtaaatgtttaacactattaattatttctggat

SEQ ID NO: 2771 - DNA, 100 bp, Homo sapiens
tatatgaaggggagtttcttgaggagagctgactcacatgattacaaggtgaagtcccatgatatgctgtctgcaagctgaggaagaaggaagccaatag

SEQ ID NO: 2772 - DNA, 948 bp, Homo sapiens
ctgatgatcagattttcaaaaacatgttgtattagaaatttggctgtatttctatgactattcttttatgaaaactgtctcaccaagatattgcaatacatctccatgggcagtttcttacaatgcccacatgtagtgacagtttatttctttatgtttatttttccattcattaattttttgaagagaaagactaaatttaatacaaactcactagttcaattcaagtagaggtgattgttcagaagaaaacttggaaaaagatgagtgttttagagactgtggaaccaatatgagaaggagctcagtcaaaaactctgactctatttctgactggaagacaaaatggtggccgagaccgtctctgcctctcccttttctctctctggtttggtaggactatttccggattttatctgttatcatctaggctaaagtttaaattccccagaaaagcttcttttatagggttggggagaaatggtgaagcccatctcaatgtggaattaaagatgtgtgagtcatctcagaacttcaaatcctacatttaatatggagattgtatatcacaaaaacaatgttcagaggcattggtagagttgctatctagatataagaactgggaagtaacacagagggaagtagaaacaaagcaagcttggtaggaagcaagaaattcccaacacacagatactttgggcagtgtaagaagtatctttattcaatcattagatttgcccgagatgtgtcaacttcaaagaaatgtgggaaactcatttctctctgatgtggaggaattacttatatttaacagaatcccagagttttgttttattgcacttatagttcatttgaaacactttcctgtgtacttttagaattagagttgcatctgcctgagaataattaagagtgccggcattataatactactgctgaagcaatggt

SEQ ID NO: 2773 - DNA, 833 bp, Homo sapiens
atcccttttactgtgttacttttacatgaataattgtgtattcaaccatcagataaaaaggaacaaactttaaaactatgactctgggtaacaatgcaaatataggattcctgtgtcatatgttatactagaataaagtcaaaattgatcaaataattatttaaaaagttaaagcatgtggggaatttttttattattcaaagtaaaaaaggtctttctaactgatataaaggccagaacgactcaaagtaaaggctaattttctctattacaaaagtaatctgtactgcatgatcgatgatgaagcagaaagtgaatattggcaactcatactaaagacaagtaattcttataattaattttatatatttctgaatatacaaaaaaatccaaagcacttcaagaaagaatcaagtaaaaaataaaaatgtaataggaaaatggcaaaggagccatcatttctacttaaagttagaggtaaaaacaaatacatgcaacagtaatatatattttgtcttcttgtttgtttaaataaataaaaatagtctattttgatagaaaagaagctaaaactgccatgactaaaccctaattttcagcgtgtttgcctagagattcagaatcctaaaacccgtcagttgctgacaccataggtatattataaggtagattacttaccaaaaaactatgtgtcaaaattcagggagactgcaaatatctgtggtagagatgaaagtgttctgattaggaataaataatgtatttccagacaattattaaatgtcacataagcaacagaaaggcaactcaagataccaatctctttgatacag

SEQ ID NO: 2774 - DNA, 308 bp, Homo sapiens
gatgggaataaatcacaaacatatagatagcttccatttgaccaggatgtagcagttaaatgtttccagatgtcacatgtaaaagatggattactaatataaaatttaaaaccctatcagtaagaatcatatacataccttttcaatttagtttgtattattcttcaggttataccagtcctagctgtctggagtttatgggaaaagcaatgaatcatataatgcaaacatgaaagagatctaggaattatctagctgttttttattaatattgcatgtgctatttaatgtgaatttcaagtcaaaac

SEQ ID NO: 2775 - DNA, 200 bp, Homo sapiens
agaagtaaaaaacctgtagcagaggctgtcagttgcctgcctatgtctcctctggagtaccctttcctgtgtacagtaatcacatggcttccagctggaggcacctgcgattgtttgcttgcaggctttttctgactgctgggagcgctggggagtaaactcaccccaggagcaggacttaagcaaagacagaagctggt

SEQ ID NO: 2776 - DNA, 803 bp, Homo sapiens
agggagtttttttgtattacctttagtttttctcccaaacaaaatatattttgaaaaactaagacaccgctgctttttacaaacataagtatttaccagtaattaaaataccaaaatgctggacctttttgggatttaatttactcttatgtttttatcatctcaaagactttaaatataaatctttctctctaccattgacctctgttactcataaagtacctcactatcttacatgttgtttacattagataaaattgcaattactcactgacattaattacatgctttacaatgatgataatttaaaaaccttgttagttaattttgtgttgatcaaacacaatttctgttagaccactaccaaatgtgatgtagaatgtttttccttgatttatgttgctgtttttgtcactaattattttcatgttatgtgcaatcaaaatttataaaattggaaaaggaaagttttaactggctgcatcccccaaagagacaggaaaagtgtacctttttcctggtggaccttgagacatgtttacatgatactttgagtagtgctgaaacttatatttcattattttgtatttcttaaattgttttgcatgtcaatatgacatgttaattgtcaaagaaaagtcatatgaaatgtcagcttacccaatatcacattttataataattaactggttgggcattgatgaaatgttcatttcctagaggatcctgaaaccataagactcagtgtccccagtgtcctcttttttctgctttacctgttttgattttagaacccttgagaa

SEQ ID NO: 2777 - DNA, 100 bp, Homo sapiens
ccattctatacttcactaatcacacagcttacatggctaccacattctccagccagacagactccacgaatccaaaaaattgtaggtttatgtacatgaa

SEQ ID NO: 2778 - DNA, 555 bp, Homo sapiens
ataaaaggggttggtcaaggttattcatttacactggagtttggatagagcagagaggaaatacttacgggccaattttgaaatcaacaatgctattatccccatcagtggatttttagaaattacttttttggatacatttgattttcttttatcatttatacttccttacaaaacagagatgcaggtattacttcttatctaggaaagtaagccaggctgcatatcccaagacattgatatccattttacctcttaagtgtttgatacctacgtgaccagtgagtttctatgccaaaggcaatgatttctcattaatcaattcactatatgattcaaaatttgagtcaaagttctctgtgctttgtttccttcagggaagaaaaaaaagaaagggaaatgaatcattctaagagcccagggaaagtttcacactgtgtaacatagattcttgaagacaagggcttcggaatctttgtgtttttgagtaacataaatagttcaaatctagactaatgatttattgacccaatatttataatcatgaatagacaa

SEQ ID NO: 2779 - DNA, 122 bp, Homo sapiens
tatggcaactggagtgaatatgaaagatagtgggtatgaagagttggggtcatcattgcaatataccagtgtcctcatgatgattttctcttattcagcacttatgatttatacttacaaag

SEQ ID NO: 2780 - DNA, 393 bp, Homo sapiens
tttttatctttcatgtatgataaaaacatcttttttataatatctagctagtttttggaagggttagtcgtttctaaaaggagcaaagttcttttcctctgaatatttaaatggttaaaatatcatttaaataaatgtttatataatggcctgaagctgctacatccttctattcaagtctggaattggctcagaacctacataacactaagtttgtagacgtagatcatcagtgaccccagagggataagatggtgcctgtaaaagtacatagattaagaaaaggaaaatctacttcagaaggggtgattcactaatgtgggtagtcatattccatggttgtagaggctgggaaaaaagagtgagaatgtaaatttttaaaaagagaattta

SEQ ID NO: 2781 - DNA, 96 bp, Homo sapiens
ggaaagaaacctcagcagagtgactggggagaagtctctctgataaatggaggagtagttctatttttgctcaaagtaaaggtcagtccaaggtct

SEQ ID NO: 2782 - DNA, 32 bp, Homo sapiens
cagggcttaataataggtaactaggagtagaa

SEQ ID NO: 2783 - DNA, 49 bp, Homo sapiens
ccgctatatctttaacatttaggcttataaactagtgtttataattgcc

SEQ ID NO: 2784 - DNA, 30 bp, Homo sapiens
atccagatcatcttttctttatccatttat

SEQ ID NO: 2785 - DNA, 300 bp, Homo sapiens
atccacttactatgtgctgagccatggggagggaatattattactgctagcttgagccaccatctctaatctcactggaccctaggtggctagagtatgcaagaaatctgtgtttcattattgaacacacattccatggtgtgttcatgggggaaagaggactccagggcttcctatttcatcatttttgctgacattcatgtagttgtcttttaactcagacaggaaaaaaaatacttctaaaactcatatctgctgaaggacttgtatccgaaatgtacaacaaactcttaaacttga

SEQ ID NO: 2786 - DNA, 799 bp, Homo sapiens
catatttttgaaaatgactatgtattgactcctgttaattgagccttgtgtaatccctttccctcaaacctgagtcgactccatgattctcttttgatcaataatatgcaacagtagagataaatcatgaatctggcagcttgtacctgtcccatagccccagctgcctatcagttatgacaatgaatatagcactgtttagttccactcaactgttaaaaggacttttgatgaaacattgtgtcattgctctagagaataataattttaggtgaatcactgatatttatattgtctcatttattttttgttttaaaaagcatcgtaaaaattgtttcaaaattttctgttttatttaatcttaaatgagacatcatttacttaaaagtacaattcaagagaaggtttgattgagtgacatttgataggaagaaagttaggttggtgtctaggtttgaaatgaagaaaatagaactggagggaagtgaatgctgttgctgggcaacgtgggtttgctgtggagaagccatttattaattgaatttaatctaacctgagagttgtttattctttgcttcttttttgttttacccttttattgaaacagaagaactagtctctccagtgaatgaagaaatgaactagtatgttaggcttgtgactccaggatttcaacccatgggtctttcaatagaaattccattctgaatggcattagtgcttgattttcaacttgtggttattctgagtcaaggagagagaaacaagctgccctaccaaatgtagcaaaactacatgt

SEQ ID NO: 2787 - DNA, 387 bp, Homo sapiens
gtcacctggcacctgcaacgccatgcagctcaccacaccccgcagttcctgggcatctgcaggctcctgtggttccagggggcctggggagctcagctctgccatgtctttgggaagaggccttctccccacagggctgcagtgaccctcaggcccacacatcttagtcactggtacatgtgcaggttactaagtgggccctgggggacactggctgttacaggaggtgtcctgagtgtcatggtgagatctccagcatcccatgcttttcgggttgtgtggagggccacaggccctggcatctgacctggggaaggtgtcccgggtcctgtgccctgcacaagtggtgtgtccctcagcatgcttgctgagaggtaacacgtgaca

SEQ ID NO: 2788 - DNA, 131 bp, Homo sapiens
gggtagtacaggctaagtccagcatgttatctttgctgtggaggtcacagaaacagccatccctcttgccccaaatgcagagccacacaggacttgggctatcagctcatggccctttttctccctcaact

SEQ ID NO: 2789 - DNA, 137 bp, Homo sapiens
taacctcagaatatttgtttggctgattgagatatacaacagacagtgaaagcgttgtattaaagggcatgggttacaattttttaaagatttcttaaaacgaaatacagcatcacaaaataccctttacgcccact

SEQ ID NO: 2790 - DNA, 1200 bp, Homo sapiens
aaccatatcaatcaccatgaacctcagtttccctatctgattagattgagcattggcttaaaaggcctctaagctttcttcttgttctagtattctgtctctgtaagctccttgcatctggctggaccaagctgtcccaatgttagaggctccccaactcctcctctgtatagtgtggatttcatcccaatatctgggacattgtcaaaactaaggcctacacagtcatgcaaagcagatccttgtaacttacatgcaaaagttgagaagagtggttttggtatgctataacacttggctgaaaatgttgatggcaatcccatcaaggagagaaagtacagctccaccaacacaaacctgggctcccaaagaccctcaccctggcctcctaaacaaggtctcccacctcaataattgggaacaaatagtcctcaggactctctcggcattgttaacttgcctagcaatgtaccaaatagagatcagacttttccttcttttcctttgtgccttcttgaaacagacaaatactgcacatgtgcacgtgtgtgcacacgcacacacacacacacgtaaatgtgtagtttgtaggtccagcaatttccagcccaactagggtcaggaccactcttctgcaccatggtgcaaatgagcacacaatcaagatggacaggtaattcctttggagatgcacagcatggaagtgacagacggcagagaactgctctttctcagcaaataatcttgatattgacaaaattctcagggtcgataggcattgtgtacattctacctctccatttctgtccctggcttcttggtacatataaaaagatgtcctaggcaagcccagagactgggaactacaagtgatatcttaacagtttcgtgccctagtaatttttacccagaacttcagcttctcgcaaattcacttaaagagtacattcaattctaactagcttcctgcgtaatattcaatagtaatttttaaaagtgtccccagtcccttgttagggatgtctcaattcttgggttgaatcaaaggatttcattattttagcagtgggtagtttcaacagaaattatagccccagccctgggtacatctcttagacccatacccaaaataatcatgaagagtgtggactctgacgtccatactacatgctttcaaatgatagctcagccactttctaa

SEQ ID NO: 2791 - DNA, 61 bp, Homo sapiens
acaattgaagcaatgattgggtttgagagtacttgtttcctaatttaacaaacaatgttct

SEQ ID NO: 2792 - DNA, 100 bp, Homo sapiens
gataatagctatcctattggtgtgaaatggtatttcttcatggttttgatttgcatttctctaatgattagttcttttcatgtgcttattgcctgttttt

SEQ ID NO: 2793 - DNA, 100 bp, Homo sapiens
aggccactccatggctgtggtgacatgaaataagatgacaagaagaccacaccatgatcttgccccaatacagacaaaaccaaagtcactgtccaaaaaa

SEQ ID NO: 2794 - DNA, 200 bp, Homo sapiens
gtcttctccctcatagcaatgagttaatcaactgtgtttggccacagtgtgctcctgcctggtggtgttttggctagaggacatggacaccattaagctgtgaattgggattattatccctgttgtacaggtgggaaaactgtggcacagtgaggttaagtaatttgccataggatacatagttattaagcagtacaaga

SEQ ID NO: 2795 - DNA, 34 bp, Homo sapiens
gatatatagaaatttaagtgaatttttaaaagac

SEQ ID NO: 2796 - DNA, 30 bp, Homo sapiens
gaaaatgcaagaaatagcagcaaagcatgt

SEQ ID NO: 2797 - DNA, 500 bp, Homo sapiens
acctgagaaataaaagcattcctatgtaagaaagtttattctcaggtgcatggtctgatgagtacagatttttgttttattttctccacattttcactttccaatcttcctccacttattccatggaaaaataaagactatatttgggctaatgtccctaattagagaagaagtgtcagtcaaagaaggttgtacttatactttgtttttaagtataattgcatggtgattggaattgaagttagatgtagcaagactgactactgaaaataggtgggaattgcacactcctgtatttaatgttaatatatggattaactattatttggcaggcattatactaagtgtttaatatgaactaattgattaccttcacaatgccccatgaggcactattatgatgctcattttagagagagagaaactaagccttagagaagacacatgacttgcttgaggccataccattagcagtcagcccagccccagctctccaccca

SEQ ID NO: 2798 - DNA, 95 bp, Homo sapiens
agccagtgaagcctcagccctcacagttgccacaaaactttgggagtaaaatctgaaaagcttttacattcaaaaccattaaaaatctacttgtt

SEQ ID NO: 2799 - DNA, 51 bp, Homo sapiens
tctacttgttacacacacatatcctcagttgcaacccatcttgagatccaa

SEQ ID NO: 2800 - DNA, 567 bp, Homo sapiens
gagatctaatttctaactgtggcattgatagaagcgtggtgtctcccaaatctaattccataccacaatctttcttgaaaagccttaactcttcaatttcaatgtcatacaagaaggtgattgtggttgtgttggagcagaaagagaaagatccagagaacgagatttgtcactgtgattcacctaacatgggttttatagacagacatttctgttaaagggaattttactttcttgagctacaaattggttacacagacgtgatagatatttttagtgagataagtaaaaagtacataatcatttgtatttctatagcaccaaggtgacacatttatgatcttggaatcaattttgtagacacaggtgagaacgctgtcactgcaccaaaggcgtcagtagcttttctctttttacacacattaatatcctcccactgttacagtcaccaccttgtctcatcttcttccagcctttagtctctacatggttcactaacaggtttccctgcctccaactatgttactattcattactcttcctaaaacataatgtgtggtggtcaca

SEQ ID NO: 2801 - DNA, 457 bp, Homo sapiens
tcttgatgtgtctttgtctctctataaaataaaaataaaatcagtatctagatggggtattgtgggaagtgaaagtatttgccaactgcttacatgcaacagtacagcttttaattgctttaaatgacagcatcacattaagtggtcaagtacccaccacctccaattcttctccacatccttgcaactcaacctacttacacacaggcatacaaactaacccctccagttcacatctgattacatccctgttcctcacccgactatcaggctccctatccttccaggaaaaaatccaaatcacgtagcatgtcctaaagtgctcatacaacccctgtctcctgttctgaactgcaatttctcatcccagcatctttttatctttgctggtcagttcctactccttctttaaaatgcagcattcatagactcatccagtgttcgtctcctctcctgc

SEQ ID NO: 2802 - DNA, 806 bp, Homo sapiens
acaaatgaatttacaagtaacaaagagcaatgatcaaaagaaattatgttttaaccttagaccaatcttttctgaaaaaatttggaagatacaagagagctaaataatgtcaacaagaagtttaaaaagaaacacatcagcaagagaccacattaagcaattatacacatgtagctacgttgcaagagaacgtagcatgtcaaaatgatgacaggtttttaacaatgagacaaatgaagtgcagagaagtcagatagatggtggtagaaccaaaaccacaatcccatgtacaccgctccttctactgtactgctgcttccagttgatgagaagtcatgggcagtcctaacaagattactgtcacaaaaactcgcctcgaggaccgacttattatccaataaattcagacaaatacaggtaagtgtactttcttggtaaaatgacacatgcatttcctgcctgcacataaacagtccctgccctttgttcacaaaatatcagtaactgtatgataaaataaatgtttttgtgaagcagatgattgctcatgaaaacgttatagctaggggatgagtcactgcataagctcaggatcaaataaattttatatacaatcaaggaaatcttagcaaagtttaaacatctataaactttcctttagcatttaaaataaaattgtactccatataacacaaaatggatagatttattatatgtattgcttttgcaagggattatgaagtccataaaatgtgcatgtaatataacttgattgtatcacaaatatgatttaaacaaatatgctt

SEQ ID NO: 2803 - DNA, 123 bp, Homo sapiens
ccccacaaacaaacaaacaaaaaacccaatatgcttgccttaactaccaaggcttaaggtgctctttaagaatcaccatgtttgccttttttgatctttaatttttcaaatttactgagatcc

SEQ ID NO: 2804 - DNA, 400 bp, Homo sapiens
taacacaaatatagattcatgtaactgccaccacaatcgggatacaggacagttcatcacccccaaaacttccttgcattgcacctttgtagtaaaatccgtctttccctaacccatggtcaggaatatttcccctatattttcttttaaaaattttatagttttatattaacatttatatctataatccatttttacttactttttgcatgtgacataaggttcagatcgaggtaggttttttttttggttcagatcgaggtaggtttttttgtgtgtgtgtgtatgggtgtgcaatttctccagtaacatttgttgaaaagactaccctttctccattaaattgcctttttccgggccgggcacagtggcttgcagctcatgcctgtaatcccagcac

SEQ ID NO: 2805 - DNA, 44 bp, Homo sapiens
caccccccaaaaaaaagcctttttttcattcacatttccccaaa

SEQ ID NO: 2806 - DNA, 35 bp, Homo sapiens
taaaatatgaactatattgaacatccaattcatga

SEQ ID NO: 2807 - DNA, 1000 bp, Homo sapiens
catggcagccctccttcctctgaaggattttttcccactctcctcagatgaagacgcggaggcctgagcgctgggggtcgcccggggctgcacagcgggtcagaggccaaccctgggcggagccaggccacaccctccctcaaggattcacagtctccccaaagtaaccgcaacgagggaccctcccgtcaccaaacttcctttcagtcacttccgcttgtactaattctggcccaaccgttcattatatttttacaattcttatcttggtgtgtattttttgaccctaaaaatcctaactccattccatcaatattttgtatatgcagatttctagcacagtaagtcataaaatgtgcctctcctggcaacacaaaaatgtcttcctgttgcttttaagaccaccgactgatgctgctgcctggatatccacttgcaagcattcccgagcctcagaacgtgaactcgcaaacgctcaggcaccagctgtcttaagcctaaatctgctctccaccaaaagggtggcattagatggcgtctcactttacatattttcatttttataaccacattcctggggtttgaagctactgtaggtggttgaagcaaggagtgaagagccggtgttgaggatgggctgatttacagggacaggagcctgcagtcaccacagcggagcctgtaggaatgaggcagaaaagccagggaaagcactgtggggacggctctgactgctgaagagtgtgcacacacacacgtacacacacacgtacacacagacacacacacacagacacacacacgtactagcgctgtgggggcggccctgactcctgaagcatgtacacacacgtacatgcacacacacatacagacacacacacacagacacacatgtaccagcgctgtgggggtggctgtgactcctgaagcatgtgcacacacgtacacagacacacacatgtacacacacacatgtacacacacacgtacacacacg

SEQ ID NO: 2808 - DNA, 42 bp, Homo sapiens
gtaccagcactgtgggggtggatctgactcctgaagcatatg

SEQ ID NO: 2809 - DNA, 41 bp, Homo sapiens
gtaccagtgctgtggggcggctctgactcctgaagcatgtg

SEQ ID NO: 2810 - DNA, 38 bp, Homo sapiens
cagcgctgtgggggtggctctgactcctgaagctcatg

SEQ ID NO: 2811 - DNA, 428 bp, Homo sapiens
tccagcgctgtgggggtggcctctgactcttgaagcatgtgcacacacacgtacacacacagagacacacacgtatacacacacagagacacacacacgtaccagcgctgtgggggtgacctctgactcctgaagtgtgcacacatacatacacacgtgcaggcatatgtgcatggacatgtgtgtacacacagcacacacacacgcatgctaaagtacctgtttccctcagatagggccacactcagcacagagctcaccaggggcccctcccagagatgcgctcccccctaccacatgaccccggaatggccatgtgtgcagggtgctcacagcacacatgtgctcatggtgcccttggcttcgtggccggctgtgccaatcacgtttgcttcatctccatggcttctctgaccatcatcccacac

SEQ ID NO: 2812 - DNA, 100 bp, Homo sapiens
gtgggagaggaaacaggcaggaatcggggggacgtgcgtgagaagggctgagccccatggctggctctgcaggtggaggtggcagcctcaagccacagaa

SEQ ID NO: 2813 - DNA, 675 bp, Homo sapiens
ccccactccaaggagaacttcagactttgagaaatcgtaaaggagggtctgtaaacgagaggtcagaacgaacgagcttccaggagtgactccccagggtgcccttttccggggccatccccacagtgacctggcatgaggtccagccagagccagcacaagggacccggatggccacctggttaggcacggatccagtgctccctacgcccacttccagctacagactcctgggacttcacaggaacccctgctggccaccgcctgctcctgcctggaagctggagttgggagtcagtcagggctgctctgcactctggccagacttgctgattcaccccatgagagtgggctcgtcccagtcccggccaccccctgccagccccagccatggtcgccgccctcccagcaggcctgcctctctctggggatggcttgtgtttcggggtggggtcatgcagtccgtccaatccctcacacacatcacccaccccggtgctctctccccgcaggggccacgcagcccccatccatccctcacacagatcaccgcccccctcccagtgctctctccctgcatggccacacagcccatccgtcccctcacaatcacaccccatgcactctctcctcacctgagcttcgcagcccttgagatcaccagcgtcgtcatgc

SEQ ID NO: 2814 - DNA, 100 bp, Homo sapiens
aaacagacacgatccatatgctcatggaacttatgagctagtggggcagacgggcattaaacaaataaacctaaacaaaaaagaacggagccttttgata

SEQ ID NO: 2815 - DNA, 264 bp, Homo sapiens
agagatttgattgtttctctaagaatcttctcttacattttgtagtccttggaaaaggggaaagtaataaatctattcaggactatttatagagatgttggcaaatagcagctaagatggtcatgtttagaaaacacatatgcctttataaaacataacactcttagtcctcagggatatggtattaccttttagtaatatggtcacttggctccaaagtagggaagacatcttgagcgagaccacattatacccccttgccca

SEQ ID NO: 2816 - DNA, 391 bp, Homo sapiens
agaactaaggaaataatttaagaaagcagtaccactaatagaatttaaaatggcagcagaagcaataacaaaaagcaaaattgaccttatagaaaactaaatcatgatacaataccagcatgataaacttagatgggtaatccatctaaccaagtttatgtccaagaatatatttatcccctggatatttccagttaaggtatggtagttgggaaagtaccaggtatttggaggtaggagtaaatgagagataatcttctctaatgacagaaacattcagagactcagaaacagatgttcagaaagtgaaggttgattctgtctgtgtctattagcaagctccacacaatgaatgccatgcaaataatcatgtaggcaatgtggactgtag

SEQ ID NO: 2817 - DNA, 1553 bp, Homo sapiens
tgatttaaaggcactggaaccaacacttgaaaacaaggtccacttacttgtactgtttccaaatctaactacctccactaagttgatcaccaaacatcctgtcaatatatcgatccatgattgtaaaagtgcttagggcagtgggaacttagagaaggcacttcatgaatttcggctcaatctcaatctgaaattcattttggggaagcgtaataaatgtgcttgctaacagtggtcaacaaggatgctgtgcctcgaaattgtacatattgtccaaaacactgtgaaatcagtgttctattcaggattcaaaacataacgtggagtggaaacagaaagcagcataattatttcttttgtcagagaagtaactaggtgtttaccatggcccaaagtagggtataaatgctaatctaagaataactaccctcacttttcgagggtaattattgtaatcaaagggcacaacaagaacagagcagtcagctgcctggttacatagtataaatacggtaagtggcaacttgagaaacaatgtgcaggtatcaggagaaaagctctttacaatattctgttatggtcagccaagaagagaaatggaaatttaatgtttgcaaatggcttttattcaggtacccagtacgactcgttctgaacattgaaagaaagggaacattgaaaataaatttccatcacaggaaatcacaaatatgctgagggatgcatggattctggatatgagggggcattgttagtaatgaaacccttggtgctggccgccatgagttgagtcacgggtttttttcaaggtggatcatctctatttagtttgaggcacttcttttgaatcctcatattaaatatgtgctcttttttagttccggatctgtggttggtcaaaatcctaactcaattaaacagaaaacacttaaagaatagtttattttctctctttcgagcagtgtttctcagcctgttaaatgcatgttcctctgtaattatcctaaaaacctcacttcttcctgcatatacttgatatagaccactttcaaccttttcacttttccccaccagtcaagaagattctgttgtttgttttataaaagagtagatatttttcaccttttagacctaaaattatgttataatactgcatatgcttcttgagccagttccaaagatgatgatttagggctgtcgactgttgagtttcattgccgcctctgtgaacaggagcactgacagactgctccaattaaaacttaaataagatgcttccacttcgcttgtttagctgagctaaaaggtaatatttcaactcacataatctcagtgcttttcccaggagttgctatctgaccaatgggcagcaccttgacaataaagttgaatataaaatctcactgtggccattattctgatgtcaaggaaaacatgacaaacacacaacctaccactgttgttattcatctccataaatactctctttctgggtagcactaaaacaaagcgaaaattgcaatgccagctcaagttctatacagtctgtgtga

SEQ ID NO: 2818 - DNA, 167 bp, Homo sapiens
aaaaataaaattggaatccacattttcctgattgtcaatcctctaacaatattttcaatataacaaggacttccatgtatatttttatgtttcattttgcttattaataagcagttaagatttaaatagatatatacatttacaaaacatgtccataaaaagtgctt

SEQ ID NO: 2819 - DNA, 211 bp, Homo sapiens
tgcattgttataggaaaatcaagaagattgtttcaggcatctttgaacacagtgtgtgttttcatttgcaaatcagctgcatttgtgaaagaagtaagcaactcttcaacatgactctatgcagtcttatcttatattgtcacaacaaagcataaatttgaaatagacccagtactgttcagtggtttaaacccccagcactgccacatac

SEQ ID NO: 2820 - DNA, 366 bp, Homo sapiens
gacttattcctggtgcctagaaaaggaagggaagggggagaggggaagctcctgaccggcgttgcttctggagagtataggctgctggggtgcttatgggtaaactttttcttcaggctgtgaattcttagtcactcaaatggtaaaagaacccaaaggcaatcattataagaatataaatagaatttgtaatcattaaatcggcaaaagaaaatttgatccatccactaaaaagcaagcaaatatagtaaatgaaaaatatgaataaagtatagtaaagaaagcacagtgaatgagaatcatgagatgaggtgagatggtagaaagaagtcataatatcatggtaatgacaatttgttcatatgg

SEQ ID NO: 2821 - DNA, 100 bp, Homo sapiens
catgaaggagaggatggccctctgcaagccaaggaggcaggcctggaacggacccttccctctggccctcggaagaacccagcctgctgacaccttgatt

SEQ ID NO: 2822 - DNA, 245 bp, Homo sapiens
ggtgacagggggttgttaaggttgtttagatgtgtgcgaggcacggagcgacgcccagaagacgagggcctccggtgagtgtgagtgattcctaaacacggcacacagccaacaaaacaagacaacaccaagaccgggtgtgaggtgggcgggaaaagcaggacttgtagttgacctctgggtcctggggatgggggcgggcaccaggcatcatgatgggtaggagcacagctgaaggccggggc

SEQ ID NO: 2823 - DNA, 284 bp, Homo sapiens
agccctgccctaagtgaaggagccctctcagcactaagaggcgccgggccagacctgcttatcgatcacctttgggcccagtgtggggctgctgctccggaaacaatttttctttttctttcaagattcaccagctctgttcaggagggtggccagcttggcgacctggacatttaatcctccagccaaagattcccttctgtgcggcagccctgagggggctgtctagatgacctcacttgagctgagtgactgcctgggatgtgggtcccgtgaatggggca

SEQ ID NO: 2824 - DNA, 452 bp, Homo sapiens
ctcaatcccctgaccccggcacggtgccccgcctcttggagcccaagccagcggggctgaggcaggggctgctgggggtggacaggggaggtgggcttgggagcactgaagaaagggtgacactccaggcatctgtgaaagcccagaagacatccctagacaaaggaggaaacagggttagggaagggcactcctagagaaggagcagcttgcagaggcccagtagtggcaccacaggggcagctggaagatgtggcaccacgggggcagctggaagatgtggcaccacggggcagctggaaagtggggttggtgggcagaggtgagactgagtcctgggagaagtccacaccggacatgggagactttcccctgacctgatgggctttatttaagcaaggaagggactggtgtgaattagattggagacactccctctgtcggcacagaga

SEQ ID NO: 2825 - DNA, 1238 bp, Homo sapiens
atttcacagtctgtctcatactaggtggggacatattccacgcttaccgtacaactcaattcggactggctgcacctcatgtactcagaagacaggctgcagtcttgtatgacatcttggatgagactcaggccgcagtcttggatgacacatacgtggacatcgggctgtggtggccggagtagagtcagagaggctggaaggaggcccttttccagggcaggaatgatggtgcctggcctggagctgtggtggggttcctggccctccattcagctgccagcccatcccagcttgcaccggagggaagcagcgggcctgggctctgcggcatcccaggggggcaggtcacagggcagctaccctaccccagcctcctccctgaccccgccggtgtctgcccagacagccggcatccccatcccgctgggctggctcccggccctgccctacccccaactccagactcatgtcaggcttcctgtcccagccggagggtgacccgaggcctgaccccagaggcccaggcgatgggcccggaaggaaggccgcctccttgatgcagccacagcaggcggggctggggcttccccatggactccctcgggaagcacttcacactttggtgggcgctcagccagggcggcccccagcagcggcaggaggcgagggcctctggggcagggaggacatgcacctgcgcctgggcctgtgaggggctcccccaccacagcgtggggtctctgggcatgccagggttgcccccactagacagccagggttctcagggaacacagagcaggcaagcaggccggcttctgcttcagcctcagcccctgtccgcacctggggcagcacaggacaggtttaggaacagaccctagctgcacgcctggtgaggaccttcacctctgggcctcccgctgctcctctgtgaaaatggaggtatcggggtgttcgtcccttctagggccagagagagatggcagcgaatgcacgtggtccctaaaggagagccgtccgtggccacgtaggaaagtgtcaggcccagctcctcattcctgggatgtggccttttctcacctgcgctgaactctgctctcaggactcaaaccctgagctgctgtggaggctaactcactcatgctccaggcccatcttctgaataagtttcccagaccctccaacctgccctccgtgtcggccctggggtgcctgcctctccttccctcttcctc

SEQ ID NO: 2826 - DNA, 1760 bp, Homo sapiens
atggatgggggtccctgcccagggctgccggcaggcggtgcaccttgcactgctcacttagtcccacagcctcgcttgcccgcaggcagtgtgtcctctgcacactttcagggctccgtccttctgcccagcgcctctgcaggctacgccttctgtgctgggcctctgggcatagttactaggcagccagggctggggccagcccttggccttagctcagctccagggaggatcaagagggtgtccagtgtggccgtacacctgggcacctgcttcagaatccaggtccttgggaaacaagtggctttggtcttgccaatgcctttgctctgttttcagctgggaattaagctggggaacagcaggaggggcagcatttgctggccctggtgcaggaggttgtgggtgagaagagccgagttcaggtccccacctgggcagcctgtggtgtgagctagaggtgcagaagcctgcggggacacggagggcagccgggcaggagcctgcggggacacggagggcagccaggcaggaggctgcggggacgtggagggcagccgggcaggagcctgcagggatgcggagggcagcagggcaggctgggctttctccagtgcttgctcccctcccaagggagttcctaatttgggtccccctgctcttccttggttgagtgggccccacgcacttggctatgatccagcagactcctgcgtcctggtgtgtccctgccccaccttcccactgccctcggcctctctcccagcccctgggagctgggttttttgcttccaatttcaaatacatcagactccatcccactgtcctatcccaaggtgtcttttgcctttctgggaaaataaagtggcaggggagtgaacccaccgcaatgggacagccctcctcctgtcctccgcgggagcagcatctcgcaggggctccgccaagccttcgaggcccagccaaagctggggtgggggcactggccggaagcttaggggagggggagcctgcaggacttcactcctgtgcccgtgtggccgggggtacctgcttgacctctgagctgtcaccgggaatagtgtccagcctgcctgcctgctgggacctctgcagagaccatgagctcagtcctcagggcctaggtcctgggttaacactgagggctgtgcggccaaggaccccggggtgggcatgaccggggtgtgtggaggaaggaagggggtctgggaaaggatgcagacaagaggtgggtgctgggccagcacctgcttctgttcttggcctcaggaccgtctatggaattgggagtaattctctgcaacatgggccctgcagccgaggtctgggcagaggcgtcagggcacagagcagtggtaccaccatgccagggagatgctcaggccaggaccaagcagaaaggggagctcaccataaactccctggggggaggggagcgctttacccccacaagaatgggcagcaacaggtcatctatcctcagggcccataaccccttcacctgcttcctggtgacctgctgccgggaagggccctgggcctcagggcctttgtggggcttcctgtacccccctgaatgctgtcactgtgcctgaaacctcaccagtggggcctcatttctttggtcctataacactccttgattttccagcgttaagcacacagtcatgagctgttgcctgaagctgacacttactgagggtgttctgtgcagcaggctttgtcctgagccttttgat

SEQ ID NO: 2827 - DNA, 110 bp, Homo sapiens
ggagccctgcctatgtgatgatggggccaggagcaccctgatcatctttagagcccacccctaacccaggtgggggcagcaggtccctgtaagcatgctggatgaaacca

SEQ ID NO: 2828 - DNA, 153 bp, Homo sapiens
cctgccggagtctggagcctgtctatttagtttgacaataaataattgggctagtatttacactgatctctagtaaggggggcacagagcagggaagggtgtgccgggagggctgaagtgtgcccctgggcatcggggcgactgtgccagcac

SEQ ID NO: 2829 - DNA, 595 bp, Homo sapiens
cccacagaagagactcctacccagttctcttttctagcccagaagaatggcatttctggaccatctggaacatctggatcatctcccctgctgatgcacaaacagccaggcctccggagaaggggggtgggacagggtgttgcaggcagagggaacggcccctgcaaaggatcatcagggagactgagcaggtcaggatggctgccggaacaagcagcgtctcagtggacctgtggagggcaggggatgagcaggtgaaggaggagatgggtggagagcgtgtacctggggcaggcctggaggcgggagggaggggctggagccagagaaaggggcggctggtggagggaggtgaggctggaggggctgggcctggtactttggatgaagccaggtcactgcaaagatgaaatgtgatagcactgggcaaaggaagcaaagcccatcaccatgagaccagctcccaatccttccctggaattcatttaggaaaagatctagagaagtcaaggtggggcccggaggggatgggatcagggtccgtgggaagcaagttcatgtctttgcaccgaggatggacaggagtgtggagtgt

SEQ ID NO: 2830 - DNA, 185 bp, Homo sapiens
ctggaggaaagcctggggttgtgtgcagggacccacagaggactcaggtgagtgagaccgcaggcaggccgtgaacagccccaatcccacgacagaggcagccaaaccctttcccaaagatgttttatagagacctggcggggcagggggggactttggtctttttcagacacagaagttccttc

SEQ ID NO: 2831 - DNA, 345 bp, Homo sapiens
taggatgccacctgtctttggaatgtctgcatgtcaggtgccccagccctcaggatccaggacaggtctggctgcggtgggtgctggatggatgctgaggaggggagggacagtcactgcataccagcctctgccaaaatggggagcccaggggcaggagtagacaggaaggacttcctggaggaggagggctggcagtttgggaagatttagatggggagaaagtggggcaagggcatgggggtgggaagtctgggaaaagatgtcctggcagggtggaggggaacggaagttacgatggtagtggggaaaagcatctgcccaggagccaatggtgcaaacaca

SEQ ID NO: 2832 - DNA, 2244 bp, Homo sapiens
cacacccgtgtgcacaagcacctccaccgctttcccagcctcctagccagagccctggggctcagctcaggcccttacccccagccccacccgaccacaggcttcacaaccagaggccaagaccccggcaaatgcacatcccctcgtccctctctgtcccagccccactgctctcccagagcctgctgccatcccctctctgtcctccaggccttgggtcctccacaccctcctgctgccacctggatgccccaacctcccgtggactgttggggtctcccaggggcccccgcacttctgtctgtatggctcttgtccactctgcccggctgacacctccggccacccgagactgctcgaatgcccagcaccccacacagctggcacctcctctgcagaccgcagcctgggagagaggggaacccacgggcctgtgagtctttcagatcctggtaaacagtaggagcacgggaaatattctggagagaaatcgccgccctcagctccagtcccttgttccagcctcctgctgggtgcccggggggagcggacgtgatgcagctctccacccagtacctggtacccagctccgtgcggagcacgggggccagccctgaggactcctactgacctgcaggttcgcggtccagagacggggcagctcacaggcaggggacgcagctctgacatcctcaggtgttggagctggggccaggaggtcatggagctgcaatcccaactcaaggactggttgagcactggcactgcccaataaaggcccctggttgagactgtgggtagggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaatgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgattgaggccagggctcaacgtgtatcaggagtgaccagggccagggctcagattgtgattgaggtcagggctcaatgtgtatcaggagtgaccagggtcagggctcaggaggtaagggagctcagggtgctctctgaagttaggcctcttagtgaccatcttcagctggatcttgctggaccagaagccagagctttgaccccacaggtgtgccctacctgggccctggaggggcaggtcagtctttcttgagtgccatcctttcacccatgttttaagcctcctgttgacaaggatctggacacaggattacattccaagtccttgctcaaagcctgagccgtctccaccccatcagccacgttggttgtgtccctgacccggacccggcctcccctgcagaccctcggggctccctccctaatcccacccttctgcacgcacctgggccaggacatgggcagtcacagctgacagattgtttaggggatcaggaagccggtgggtgtgcagcagatgcctgtgtggacatgcacacatgcacactcatgcccgcttccaggcaggaagaccggaggctgcacgtgggcagcggcgggtggtggtagtccttgaccagggtgtgagtccagtttgtcttcaacctggtgctgggaagtggggttggggagggtgtgaggcatcctggggtccttggtgggttagactcctgaaaccca

SEQ ID NO: 2833 - DNA, 132 bp, Homo sapiens
gactggcatctccccagggttcctatgtgggtgacacagatcaacgtgtcaatggtttcctcactgtccctatctgaccgcatggccctgcctgtctctcctcctccctggagcccatgtttgggacttcca

SEQ ID NO: 2834 - DNA, 100 bp, Homo sapiens
ggcataggagctctcctgaggaaaggcatgggaaacagagggaatagcaagtgcgaagacctggtatggaagtaagaagtgaccggagtgttgcttgggg

SEQ ID NO: 2835 - DNA, 351 bp, Homo sapiens
gaggcaatgcatcaggcaggcggaaccctgcccctcccaggctgaccccagccagacggggaaggacctgggtccctgctgtgggtggtgagtcccatacatgtccctgcccaccctgtcatcctgcagggagcaaactgatcccagagggggtgcccagcccacgccgtgcagcaccgcagggggaacccagcgtgatagagagcagtgtcttagacctggctccagcgccgaggctgcggcccaatcgaggccgggtccttcccctcgagacttcagcctcggctctcctggacttcagggtgacatcaccagggtgttgggggtcttctgtgatcctcctacgaatac

SEQ ID NO: 2836 - DNA, 104 bp, Homo sapiens
ctatgtttctcaggctaatcttgaactcctgggctcaagtgatctgcctgcctcagcctcccaaagcactgggattacatgtgtcaaccaccgtgccctaccca

SEQ ID NO: 2837 - DNA, 778 bp, Homo sapiens
ccaaatattacaatctttccaccatgccaaactaccttatgaatgagcaaccagaagcgatgaacatatttgctttgcactaatgctctagaaagggcaaatgctcagctcctagactcacttgccctaggctcactctgaatcccagtaataaaatgagtcatctttaaggtacaggataaagagctttgagagccacatcctgcttttgcactttcttctctggttgctatttcagagttttcttttaaccacaccgtttttaatatattctctgtcttgctaatgataggaaacttgctgctgcatggttccataaaacattatctcattatctcctttgcctctcactgtaaagtactttgtagcattgaaagtggcatatgaaaaaaattaatttcattaaattaatggagagtatcatgactgctcagttacggctcagatgcatttgtagagggactgtgtatgcatcagagcttgtcctttattttgccatttttcctcccacatgcacccaccaatgtccctaggaaggaagaaataattctaaatggcatgctttcaagaaatattgttaccactaacaacctggaaaatcccaaatacaaagcatgactttatatggccaatgagaaaattgcaggggcaatccagttatcttcaccatcttcctaagagatacaaaagttacagctgaatacatcatgctataattcacagcaatccataagattgatcatgtctctccaagtgcacagtgtttcagtttatacaa

SEQ ID NO: 2838 - DNA, 182 bp, Homo sapiens
agaaaaaacagtctggtccctccaatcctggagcacactgtatctgtaccacaggttacccacccaactcgggggaaactgaggctcagcaaatttaaaaaattacctccctccaaaaaaaaaaaactagaatatcttctgagaaataagcttctgctcagtgagcttaacatagtctaaga

SEQ ID NO: 2839 - DNA, 249 bp, Homo sapiens
gggccattggtctaggacttgtaacatctaccttgttttagcttctataaatgaaagcaagactcccacattaagtaatgctggtacccccatgaggccatcctacatatctgcactctattgtggaactcctccagatgacctcccactggctcattcagttacttcttggtctcaactgtcccagatcctttaattctctgctttggctttacagctccactccaactcaggtcaaagattcactgg

SEQ ID NO: 2840 - DNA, 35 bp, Homo sapiens
tgcttccggcattccattattccacttaactttac

SEQ ID NO: 2841 - DNA, 758 bp, Homo sapiens
tcatctctcctatcgtctgggttctacctggtagagatcaatatctaaagctaaatggagatcaatggatagctttgcaaatcatcacctgataactggggtcccctagtaaagaggtgctgcagaatgttgcttggactgaaggccaaaatggaaccttcttaatgaagttcctctccaaatctagactcagtatctgcctttagtagagtcacctctgccagtacaccctgagtgcatgttgacggtcagatcagcctgcctctaaaacccagacctccacagaatgaggaaccaagaaaatcagagatgggcctttgttccattttcaatgcagtaactacacacatgagggaaaacgtgcttcagtggaaattaagttatctacaatcaactggatactcactttccctccaggaaaactagtaagaaatggagaaaacatctcctccagtattttcccatcgtttggagggaagaggaactgccctcccaccaccctgtcctgcaatagaatcatgaggagggaaaaaaatcatacttccccacaataaagattttatcacaaaagatggaaagttcggtacaaataaaagttgtcagtttcataccactttttcattaccgtttctattgcactctacacttttatattatattgtcagataattagttatttttgtatctgactcttctatcagactgaattccttcatgaaaatcatttttaaatttatccttaaatatccatatctgat

SEQ ID NO: 2842 - DNA, 1380 bp, Homo sapiens
agatttaattagtgtataaacaccaagtctctatagaacagaaactcttacaattacaaagcatagacatatttatgcatcattttgcattgtttatcttcgctatttacctgtctactaacagagtgaactagatccataactgtttccttaaatcaacttataattccccatcaatgcaataggttcatgtttcacaaaattagacctataaatttcctactcatttaattatgcccctcttcaaaaaaagaatttaagacagcataccatataggaaaataaaatttttttagaataagtaagaaaaatgaggcaaagccacacataaatttttacctttcttataatgttcctttaggagtgctcatctgtctaccttagtgccacaagatggtatggtgaacaacttttcaagaacaacattttacaatttactcataaacaacccaataactttccaaaataaacccagacaacattgacagaggctggtggttagtaaagtaacatgattcagccttggtagctattagcaagtctagcagacttcacagggattctctgaagacactagacagcgatgcacttaaaaaataaatcgacttttggtctgaaaccattagaagaaaaaaatgaggcagaagcaaaggtcaaggctgaagtaggttgataaagcactgctcccttgaagataccttctctcaagaggcactccctgcccgatattcccactgaagaacagttctctggcagttaataatgggctaagagaagctgtgttcttttgcttacaggcccagaattggaactcatgatggtgctacttagatcacaccccagtgggcaatcccagttgagaaatccggaaacactagagaagctaaatgaagcgtttgactcaaagatgggctgagtgtgtaggtggctggtgtttggtgcatattgctttcatagtaaataaagcagggagaaaaaagaaatcaaaatggattcttttcaacttttttttaacttcccaagggttggctgaggataaggtatcactgggacgtagaaaaagctagggaaaatgttggcttctgcttgcttataccagtaactttattattttatttgtttgaaaataagagaaggcaatccaactgcagccaggacaatgacatcagcacacttaggaaggcctgatctggggattgtcttttaaaatattgagtaacatctttctgaccaagtgaagaaagggaaaaaagttatacttatcttctgttcaataaacactcttccttaaccagttgcactgcttccttaagacaatctggcagtatctaaagcaattggaacagtgatcttaaccaaaacaaatacctcaagcataaa

SEQ ID NO: 2843 - DNA, 67 bp, Homo sapiens
atgtatgtcaggtgctataaaggtccacttcattatcctgcttctctatcataatgatgaagatggg

SEQ ID NO: 2844 - DNA, 21 bp, Homo sapiens
cccatcttcatcattatgatg

SEQ ID NO: 2845 - DNA, 38 bp, Homo sapiens
tatatcatcatcattatcctttaaacacagtgattggc

SEQ ID NO: 2846 - DNA, 711 bp, Homo sapiens
tttttaaaaaataaataactaaacatgctgattagatcattctgagatatcaaatcactctctaattttcgatcacctactttgatctcagggacccagccttgtcttccctctgaattgtggagacccagcctgtaggtcataaaataaatttgaggagggaggcaatactgaagttccttattcacagaagtcaatacataagtgatgtcatcattacagaggtcagacttggtacttgccagatataacagcctgatctatttaatgtactttctgtgtttgcaagaaattaatgcaggaatattgtcagatgaacatcatattatctaatagtttacctaagtgagacatctctgtgcttcattgttcatacattattaactctacctgttgaccaaattattatttactaaaatgttttcattgattgatatttacaatttatttggaactgctctcaactagctagaagtaatcatcaagaatttcacaaaaccaacctcctgttgggtcatcatcgtgaacttgcaagcatcagaagactccagtttggaaagtgtgcaaaggagaggtggtatcccttcaatctttcagaagcatgctggaagagcaatctttccaaaatatgaaggatgactacttctcaagaaagccgtaacagctctctattgccataagatcaagcaacagctcctctgtctggcttcc

SEQ ID NO: 2847 - DNA, 100 bp, Homo sapiens
taggtttttaggggaggctgttacatgagaatgctatataaacagcatgctgtttgcaagtggttgcagttttcctgcctagtctgctgccactagactg

SEQ ID NO: 2848 - DNA, 145 bp, Homo sapiens
gtgctttataaccctggttctatcccacccactatgaaccctcacaaaagctagagccaagtcactagagctggttccttttgttctctttttattcttatgactgtgtcctgccttaagggtgtcttctgttcactcgtggctg

SEQ ID NO: 2849 - DNA, 851 bp, Homo sapiens
gggtgtcttctgttaactaatgccccaactatccccccaagtcatttcccatgaccccactcccagcatgttttccatctctccaatgcctttcctctcctctgcttagccgtggtgattgcctccatgtctttacttgcagagcttcccccatcttgaacatctttctctctaactctctaattcccaccaatttatcaagactcagaagaaggaccacttagctttatagttaacccccgttattccatttccctcctgttaatctccttcttctctgacctctcacagcaccagtagctgcaatacatgatttagcacttgattactttccgtctaatagggttgtctaattgtttcagcacacatttgatctgcagttgaactgtaaagtcttcaagggaaggaccccatgtagtcgacatctttgctatgtcccagagggagagacatggtctgcattgtaggcaaacaaatatttccttccccagggctaacctaggtgaggaaattgacaaatactttctgtgcacctgctggaagcaaggcactcttccctgaccattgcagcctccttgtttacataaaagcaacacaggtgaaaatataaatgaacctaagattaggaagactgggaaaatattaatgctcatgaatatttagcagggctccctcattaactgggtttagagaggtctcccttacaatcacgaagctctaataaatgctggcatttaattgtgctcatccaataggaactaagctgcaggggtttgtgagccaagaagtacaatatggtatagagtagtggttttaaaaccaagcctcacacaattcctaaacactttcag

SEQ ID NO: 2850 - DNA, 141 bp, Homo sapiens
tagacagaatactgcttggaaccagaagacaagatattttttcattcccaaccaattattacctataggaaactagactgtgcaatttttctgaagttcagtgttctccacttcaggcgtaggtagggcttcctccacaca

SEQ ID NO: 2851 - DNA, 38 bp, Homo sapiens
aaggcaaagaggagccatttaaaacatgtatcatgaag

SEQ ID NO: 2852 - DNA, 98 bp, Homo sapiens
acacctgtaatcccagcactttggaaggccaaggctggaggatcacttgaggtcaggagtttgagaccaccatgggctacatagtgagacaccaccac

SEQ ID NO: 2853 - DNA, 2167 bp, Homo sapiens
catgcatttgagagtgctagggaggtgagaagatttaaaagtttctttaagttccaaggctagagggagaattcttcccatcagtataagttggagtcacataaaccataatgtatcaggttcaattcttaagagttttggtcaaactacaatacaagcaactgtattcttgctgtgtgactgaccagcctctcttatgaccagagcatccatatttggattcaagttgagattgaatatggcttctctttgatccttacaagagcatccaaattacctgactaaaatgttacaatggccacagatatatattttctagtggcactactttcccatcctctacatttcgctttcttttctggctcaatggactctgtttaattcagagagctagtttgctaggcccctgagcccctgcttgttggattcaaccagactcaaacatttatgtagacccagatgttattaaagcaagaaccgaagatttctaaggcaagaagggcctttagaagacatcttaccttgtctcctggagaaacagccacacaaattctttgaattctttggaggtagccagggcgctttcttatttttaatatcccagggaattcatccccacagccttccttggtcacacttaggtattttaagtgcctccctgttacaaatttcacgttttcaaattactcctctaatggttacatttttcatttctcctgaaaattggatttatttccttctaagaatggaccatgctctttaaaatcagatcaatttatatgtccatcagtggaaggtcttaaaatatctcggtagtgtggatcatcaaataataaacctatattgggtaatcagtagtctagaaaggatggcatcctgaaagtttaattttagtcaagatgatcaaattccaatagaagttcacagtccaatcatgctgctcagtagttattaggagagtcattgagctgggttttacagatacaacctcaattctgtcttccccgagtggccgcttgaccctcactctaggaactaaatgatccaggaggagcgttaagattctggcgggttagcactccgggtccattcaccttgttatcggctctcttcctttccccgcgtcagtgtccacagtgcagtgcccgagcttcagccactactccgtgtgcacaagcagctgccccgacacatgctccgacctgacggcctcgcggaactgcgccacgccgtgcacagagggctgcgagtgcaaccagggcttcgtcctcagcaccagccagtgcgtccctctgcacaagtgcggctgcgacttcgacggccactactacaccatgggggagttcttctgggccacggccaactgcactgtgcaatgcctgtgcgaggagggcggggacgtctactgcttcaacaagacctgcggcagcggggaggtgtgcgccgtggaggacggctaccagggctgcttccccaagcgggagaccgtgtgcctgctcagccagaaccaggtgctgcacacctttgacggcgcctcctacgccttcccctccgagttctcctacaccctcctgaagacctgccctgagcgcccagagtacttggaaatcgacatcaacaagaagaagcccgatgcaggacctgcttggctgcggggacttcggatcctggtggccgaccaggaggtcaagataggaggcatcggggcttcggaagtcaaggtaaggctccttgctcctttggaggggttcctggtacgtccagccaggaggaggagctcgccatcctcttcaggtttgcctttctgcctctgcctatgagtggattttagaaagaagatggctccaaacgggagcgttttctaatgatctgcaccaaataagaattatcaggtggagaaatggcatgcagctgggatttctccaattagatagagcaggactagctctccggaatagcaaatacttacagaacacttactatgtgccaagcactattcttaaccgtgaagggagattcacacctgcctggctggctccagaatctgcgctcttaacccttgcaccctactaactcccctacctatacatgccagtctatgtggggtgatgtaaggggtgactcccacccctctgacttgctctgaaaaacccatcattaggcaccc

SEQ ID NO: 2854 - DNA, 1782 bp, Homo sapiens
ttggaaaacaaaagccaacacagtactgcccaaggagataataaaatacgcatccacaaactggaagggatgtgtttttattctcattgccacattggcagagatttatttattaatagactagtaggaagtagatagaagaatggacagctagatcattagagatatgctatgtgccctcgaggagctgggacacagaaaaagtaagactggaagagaaaagcagccagaaaggcagggaaggaggggagctattttgaaaggtaccaaaacagagatgccaggcggcaggagggagccacgtatctaagacgatttttgctcacactttagtttcgtttgttttgggctagctttgggtccagaacacacaaataaacagcaaatgggtctaatcaggggaatccaaaaagaaataaataaagaagcccatgacaaatcggttggtatctttgtgggttccatcagcttcttgacctctctcaaaaggctagcaatagggcagaccgtgtctttatcccacagcctaggaaatggaaagtgctctgtgtgtctctggaattgataagaatgacttgatttttcagttgaatggtcaggaagtggaattgccttttttccatccttcggggaagctggaaatttatcgaaacaaaaacagtacgacagtggagtccaagggcgtggtgactgtccagtactcagacataggtctattgtacatccggctgtccaccacatacttcaattgcacagggggcttgtgcggcttctacaatgccaacgccagtgacgagttctgtctccccaacggcaagtgcacggacaacctggcagtgttcctggaaagctggacaactttcgaggagatctgcaatggagagtgtggggacctgctgaaggcctgcaacaatgactcggagctgctcaagttttatcgaagccgctccaggtgcggcatcatcaacgacccctccaacagctccttcctggagtgccatggggtggtgaacgtcactgcctattaccgcacctgccttttccgcctgtgccagagtgggggcaatgagtcagagctctgtgactctgtggcccggtatgcaagcgcctgcaagaatgcggacgtggaggtggggccctggcggacctatgacttctgccgtaagttggggttggattctgggagaggctttctagctgggaaataggtgccatgctgggccttactcaggacttcccttccaggtgggactgagctcaagggtgatgttaattactgtgtatacctaccctagtctgatgtgtcctcccaaagactcatcaccccaaaccggagagcctctcatctttactttttttcctaactgcacagtacctcctcactgcagaacaattaaccatcctatttgcatgtggttttatctagcagagggtagaggcaccatgtcaaaggactagaaatctttgtgatggctctgtaggtgccttctcccttggcaaagaagagccccattgattttgataggaagtgatcggccagggcacctttggggcatggagattagcatgctccccagggcaaacctgacaatgggtattaagagagtcctgtgttgctggcttttaattttgtcccgaaagtatctgacccctctcagcaatgcagtggcaagtactagtagtaattagaaaactttctgggaagacctgatacgtaacacccttgattatcagggaagccacagggagaagtaacatggcagaaagcaggactcactcgtg

SEQ ID NO: 2855 - DNA, 640 bp, Homo sapiens
ttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtattttgtactttgcagtatttctcttgtataccagtttgtgatgttttctctaaaaacttgaagttcctcaggcctgtaacttctggaaaagatgattattcaaaataatgttttggggtaaccagtggagttggg

SEQ ID NO: 2856 - DNA, 581 bp, Homo sapiens
attaggtgggacaaaaggaataaatgaagactgcccagaaaaaactgagactatggacattcaaatcatgggagaaaataattttgtagattatgttccattgctaatgaatttgacttagaaaagaattgccttatttttaagagattgtttcagtggttcacataaaggctcgctcactggtttctcttgagttccttacacactatataagttgttctttcagttttatgattcaactactgtttttccttcagctgactttatttttaaacacccttaaagacagatatatctcatggcaaatttggtatcctgttacagccttggctcttaaacaactcaaaatattgggataggctgtcagtatgttaaggatagttgctcctgagtcaattcttcacttactccctctgttgttcttggctggatcctaacgctgatttccactctgctgtcacaaacatttttccccccgtaaaatgtcttaatgctgtcctaccattattttaccaactgtgaaagctggctttaatttttaggaggaaaagaaaagcctgcatgtgttctttattggtatc

SEQ ID NO: 2857 - DNA, 1990 bp, Homo sapiens
ggtaaaggtaggcgtattttaagatattttcttaacttgagcagtagccaacaggaaggataccagtgtctctctctcttagcgacacactccttggtcttgcttaccaactggaggacactaggtagaataaccgagtatgacaattcttaattgtttacattttataacttcctgtccttcaaaagagtttgaaatgtcattttgggaaaagagagccagtcaagctagtaggctgattgtgaagaaaatctaataccttatctttatctcaaacctctgtacaactttattttcattgatgggatactttaacaaaaatgaaattttttttggtttttaaaatatgagtgattatgacctctttggggatcatgcttcaaaaagtcagaaacctagagacaaaactgtcattgatttttaagaagaaacacactaggtcaaaagaagatgtcctggaaatatgaagtactctttaaaaaccatgcatttggagaaagtaattgtttccttgaaaaacatgattaaaaactaaaactgggatgttcctgtgtgtacacagtgccaaatggttttccctttttatgttgtgttttagaaacagcacgaaagttttttccattttaaagtgagaaaacattatatttagacttccataattccaaaatcagaagctatttttaaaattagcattttcttgcatcaccaaatggtattcaattgtttgaagctcaaaatttttaccattccataaatgtttgtgaatttttagacagtgccaatttaaaagtagagatagccaatctgaatacggtgaaattatggggatctctggtgattgggatgaaaactctggccttaaaaggtccacttttagtatataattgcctaattagcaatcatttttattttttgctcactccctggtctgaatctatctgtctattcagatattttttggtaggtttggaaaatggagaagtgagcctaattggtgcctaattgtctggtgtatcattcactttattcagtttgttctatcaatatgatttacccctcaaggttaacctagcaggttgctcagttattatctctcaaggtcacagtactagaaatacttggcttgcatctttcagatgccattcatgttatcaagctcaaattatagttggtcacaggattctaaagtctttatttgacttctcctttttgaactggctcaaatggaaaagtgtagttgcttttaaatgttaaaaataagtttaaactttatatttcccattggtttcccctattttgtcctttctttgtgtgcttgaaatattttatttttcagtttgtcctcatagggaatcaagtattttagctaggtgatgtcttgcaagtacgttccactttgttacaatctactatctgtatatactatttgtatcttaattcttttatgagatgttctgtaacatttttctcactttgacaaatgtttttagactgtacagtcaagatctggcgcttgggggtaagtggaatgatttgctaatattgagaatctgttgtatcaaacataataaactttttttgagatgtgctttgtagtttggtaattcttagattttactattggtttctttgcttagaatgagtttctaaatgtgaactacaaaaaccactctacttcaagcatgatcattagaagaaggttagggatgtccccaagcatcattttatcccttaaaactacagatagtttaggtttctgcctgaactaatctaagttagctttttcttcacatctcataaactaatggtgggaggacacaaagagctttatgaaaacatttttgatggcagataaggacggagtcataaagctgtatccatgcagatgtgttatgctgacattattgttattattgagatggagtttcactcttgttgcccaggctggtatgcaatggcgtgatctcggctcaccacaacctccgcctct

SEQ ID NO: 2858 - DNA, 55 bp, Homo sapiens
tatgctgacattattaaagccaacagatagctaatctgaaaagttcatgtgcatt

SEQ ID NO: 2859 - DNA, 519 bp, Homo sapiens
tcatgtgcatttttcttgaattggttctgtgtactgcatttgttctgtggagcacctcagtgaatagaagattttgccctttccactctccagaggcttttgaccccaagttgtgctctttgacaatggagagttattgcgtaaaaagtgacaataaaatcttgacatttcatatctgcaaaatttcacttaaaaaaaggtaaatttcataggagtaagtcgcaaaggaaaatccataatgtcagtgctaataattgataagattagatctggaggggaaattgtaagtgcacagcattcattaaaatatttgattcaatcaactaattaatagcaaattcaaaacaaaattggaaatagttatataaaaattaatacaatttgtttgatcaaatgttttctttagaaagtgatctctcaaaaattgatgagtgttggtttacttctaaatatggaattgaaatgactttcagaatcacagcaaggtctcgattttcagcacctgattactgatttggt

SEQ ID NO: 2860 - DNA, 654 bp, Homo sapiens
tcactcatttggatttgtaaagtaaatgaaatttcaaaaaaaaaatctgtcttgagaaggtatgatgcctttgaggttgtaagtcaaatttatgtgtatagttttgctagttattaaagggatgctttataattaagcttctttttgtgtgtcctaggtatgtttctataaaacctgataaccgaaaattggccaacggaacaaatgtcctcggcttactgattgacactttattaaaggaaggctttcatttggtcagcactagaacagtatcttctgaagacaaaactgaatgctatagctttgaaaggataaaaagccctgaagtgctcatcacgaatgaaacaccaaaaccagagactatcatcataccagagcaatctcagataaagaaatgaagttgtctatcctcttttaaagagaaattgccatttttcttgtttcattacgtatttagggcatacatgttagccaaatctacactcagcctaactcttggcttcatctgctgccatgccgtctctgggcaaccaggccccaactgtgcttaagccataatgcctgctgctctctagacaactccatgtacttggtgctttggtatatgttctaccttcaatacatctttccctttctcttcttcatgaatgctta

SEQ ID NO: 2861 - DNA, 42 bp, Homo sapiens
tagttgggccttccgtattttcccacttatgtttgtttcagc

SEQ ID NO: 2862 - DNA, 45 bp, Homo sapiens
ccagcatgtttttatcaatcacagtttcatttctgacaaggcacc

SEQ ID NO: 2863 - DNA, 189 bp, Homo sapiens
aaggcaccaagattttagcttatgattcttgaacctcaataatttaccttataagtgattagaagttctccctacaaatcttttctgaaaaacagctctaatgcttaattttactcttggatttaatatacaagttgtaattacaaagagttcttagggtatggtaaagtcaagattaatttaggctgc

SEQ ID NO: 2864 - DNA, 564 bp, Homo sapiens
tatttaggtgctttaaaaatgtatttgaaatcaggagcctgaagtagtataaaatggtcacaagaaagcagcttgagaaatacatggtttaggaaatcaaaatctgtttctaatttgtcctttataccatttacaagtgacaaacttcagctttgctttataaacttttgtactgattctctatcataagtaatagaaatgttcacatcaatagagaattacaccactagagactatgctggggtaataaaagatttgctaagagcactcaatctcttatattctactgctatttttcctctgtgctagggaagttgactgtaatggcaagtttagcaacgtagaagctaccgtgaggaaatcttcaaaaataaatttatgaaattgtattaccttcctggaaccaaaggacccatgggagacagcaatgtggcatcagacttagcatttttaaacaaatgctcagaaataaagataggacattttaaaattactaaaaatacttagctttctggaatatcaatgacctagtaaaaaacgtaagtactgggctggcctggtggt

SEQ ID NO: 2865 - DNA, 105 bp, Homo sapiens
catctgtctatgatttaaaaacaacatcaacaacaaaaaaccccaaaaatcacaattaccggctttgctgtagaactatatacctcaagacttactaggatttct

SEQ ID NO: 2866 - DNA, 689 bp, Homo sapiens
aaattacaaaaattggctgggcatggtggcacgtgcctgtagtccccagttacttggaaggctgaggcaggagaactgcttgagtctggaaggcggaggttgcagcctccgccgagatcatgccattgcactccagcctaggtgacagagtgggactctgtctcaaaaaaaaaaaaaaaaaaaaaaggatttcttttgggcctattataaatgaaaagtacaaattttatcaaaacacttcatcatcgaaaataccttaatatttaactaaactatgagatccaatcacaaaaatattttcatggataaaaagctaaaatcttacatgggtgaaaatggaaaatgatattacgcatggcacagaataaaaacagaactaaacatgtagcaaaataaataggaccttgctcccaaaactaaaatgtgtttaagacttgcctaaccacacaaggcttttaggtaggtagtcttctgtaccttcagatttcacaccaacacctcaaaatccagaaatcattaaagcaaatggctttttattaaacaaatggctttttatcagtagggtaaaacataccaaataagtgtttcatttcatattattcttcatcatctcacaacacttctggaaagaatgtgaatttcttcaggttcatgagtatgaggccaaataggagagatttgttttaccc

SEQ ID NO: 2867 - DNA, 403 bp, Homo sapiens
cttaaacttctgggctcaagcaatccttccacctcaccctcccaaagtgttgggattacaggcgtgtgccactgcacatggtctacgctttctgtaataagagacctccaaggaaatctggctgcaatgtttaaggttccatgagttcttttaagatgaggactgagactgctatagtggtctatgtcatactcccccatagtgctgggcatctaacaagctcaagtgaactgaactgaaacatttggaaactatagtctcagtgaatagatgcttggaaaaacaagatttatagtagattcaaagatggaagaggataatttaaataatacaatctgaaagagttgactcaagttacagattacagaaactaccccagagtattttcaattagtttacttgg

SEQ ID NO: 2868 - DNA, 1551 bp, Homo sapiens
gtttatttgggtaatgccatatggaaaggagatgaaaatatagatgtatatggggatataaacttgttgcagattacacaaaattatatgtttaagcagagaatagtccagttaaaattgggatatacttaatttgctaagaacaatgtaatgctaccagcatgcttaaaattaaaaaaactaagagaatgtaagttcaaaatgagtgtcacatgactataattgatagtaaatcttcacttacctccataacttaggagtcatgaaaagaaagaagttagcagaccaggcatgtaaatcagatgtaagtaggatggaatacagaaatattcctagttctgggtaacccaatttgaggtcattttaagtttactgaatttggattaatcaattggttcaataatcaaggtaaaatggtccaaaagatcctgatatatccagaagacatattactgaggttttacaaggctaatttgaaatgcagattaacattctaggtttccttacatatcattaaaatagaccatattaaaaatcaatttcagaagctgctttatgactggaataaaaaacaattaaagatgtagagtaacattgtatttctgtctgatgctgggaggctattttttcatggcaagtaataactgggtaaacagagagatactttaactttacaaataggaatcctagaaaacaaggttttgctcctagaaaacaaaaatagttcctttcaattaattttctaaaaatggttgcattggtcactttttaaactcctacaatctaagcagcactgaattcctatttgatttttttttttgctaatagttttcttcagaagcaaacctgctttagggtgaaaaaaagtttcagaccttagacagaaccttcatttcctcttaagtatgtttctccatcaaaaacaagtattcaaataaagaatctcaattatctaaacctatttttggccatcttccggaatttcttgttaaatctcctttgaaatgccacagttgcactcttggaaaacttgtcttcctggttttcaaatttctgtttattattacagctcttcagctagaatgccaggtctttgtgctgtactgtttcttgaaactggagactagcacacttcccccaattcaattacttgctttccatttgagaaattaaagccaggtcaattttataaagttttaactgactgaattatttggactttaagttctcaatttcattcccttagcctaatactgggaaagatcttggttttattgagagaaggtaaggtttaagagtattaacacatttcagtcattgactcttataattgatataagcgtagggattttctaacaggcacacgcttgagatatgacactctaaggaaaaaagggagagttcttattcaattctagaaatgtttaagattacatactaatgatatagtttatttacataaatgtgtgttcatattttttctaaaagaaagggaccgactgtccttcataaagagcttcagtcagcttttctacccttatcagccttatg

SEQ ID NO: 2869 - DNA, 1862 bp, Homo sapiens
ttaaactagtttcttaactatctcctttctttcattggtaactccattgtcttccagtatagaaaatgtataatcttttacacctcccttttatccaacccatcatgatattcaacaactttttcctttgaaatatcttaaatttattctttcacctccattctcctgccactattgctgttcaggtttcttcacccctagattactacagtagtcacatgcccagtttccttgctaccatattttatttcttagacatttctatatatagtattgccacatttaattccaaacaaatcaataggctataatgcctccctattccctgctatatcaagaccaaaatcctctaattggttttctaggcaaaggctcaatagcctagttctaacctagtaatacaaattcatgtaacctttgccttaggttttatggcacagatcccaggttacttctgggggaatgttgcattcaattttggcttaaattcctacctacaaaccagacaagtccattacttgacaactcaatgcattttaatttacaagcatgcaggccacaaattataaaatgaagactttttactgagtcagcagaaacaactgttcaattctcctgtaagtccccagttacttacagttttctgctgaggtgatcatctcatgtggcatttattgccctctactaaaatgagctattatctgacactctgctctgtacagacgtgtttctgtttccattttcagttccttctccacatggtctaagtaccagtagtttagtcagttctcaccttttttgaggggaaggcggcaatggtggtatcaaaatttacacctggaaaacaggtcataaagaaaatcaatatagaagggaaagtgctttaccacaggaattattatttaattgctggttgaattcttgacttttggttaaaaggtagatataacaaatatgtaaaccaccctcaaagccaaaccaaaaccaacagcaacaggcttttcaatcaatgtaatttatacattgggttctggaaaacagaaatgtcctataaattttatataaatgctatataagggtacataaaaatgaatccttattataaatatgacttaaatgtcatagcagtaaacaaatggtacttatttgatccacaaatttctttgccttcttagatttttttgaaagttttggtgtggcttggtttctttttgaagggccgagctgggagaaggaggaaaggcatttggtctcctataaaattgtccaagaaagtttatgagaaagcctatatcactcaataaggtggctccagtaagtttaggcattcaaaaacattccattaattttagagttaccttaaagaattacagcagatcctcaatgcttttgtttctgtgattacggtaatggcatttcttgaaaagtatttttaaatgtaaggattctttattctactaccacctcctatctcctcagagatacacaaataaaggcccaaaaataacagttaaactttatagaatttcacacttcattggaaaggttagaaatgatcatttagatcactaatgaccccccaaaagataacaaaatttcacaggcctgattattcatacccctacccacactttgctggttttgctgaaaaaaaaaaaaaaatgacattttaaggtacctgagacctgaggaatgaatgttaatagctcacacagaatgagaagagctctgatcagtgaagtagtaaaaggtagagggcactcctaaattatcagaaaataacctgcatatttctgtatttatctagcaggtatgcagcctttctaccactttaccataaaggtattactcctgattttcag

SEQ ID NO: 2870 - DNA, 488 bp, Homo sapiens
ttcccataagacagcatgcatttgttctaagtcaggtatggaagcttaaatgagagaaatggtatttttggctgaggaggaaaagtgaactggaaaaatttcatgtagggggtaaatagcttaagttttagacaattgaagatgaaggaaaggacattctaggagtaaataacttgagttaaggcttggatgaaaatctgagtgaggtttgaaaaagtattatttctctttggcttaacaacagttattatggtattcattgacaattactcccatagtggtaaagtcaatcttacttaaggcaaaaaatatcctagatatagcattttgcctaggcaactctttcctctcaagatttctcacctgatttgctgagttaaaagccacagactcccaattatttagggtaaacttatttatgcctaggtttccttccagtatttcttacaagttttttgtttttttttcttcaaagcaacacaccatgg

SEQ ID NO: 2871 - DNA, 144 bp, Homo sapiens
catgcacagacagtggccacactgatgctctcactgagccattgggtcctcaattctgctgccacattgagtctgctctggtcctcctctatcaaggttcaaagttcagagcagaagcagccagttagccaaggtgaggttatc

SEQ ID NO: 2872 - DNA, 28 bp, Homo sapiens
ctcaaaaatgtctctctctttctctctt

SEQ ID NO: 2873 - DNA, 21 bp, Homo sapiens
aatggaaagaaaaacaaaaat

SEQ ID NO: 2874 - DNA, 200 bp, Homo sapiens
gaccctttgacagagctgtgtttttatcgatcaacttttggctactggggtaccaatccaggaaggaggatggtggggtgtaacatggactttgccaacaactcctatcatctctatgaagatgaaagcactaggagagcagggaccttgtctgtcgcactcatggcaagatctcagagattagaattgggctttgtaaa

SEQ ID NO: 2875 - DNA, 63 bp, Homo sapiens
cctggcccttttttgcagcttttgtttaagatgttctttccaatcaggatgcctccccactgc

SEQ ID NO: 2876 - DNA, 668 bp, Homo sapiens
gtgtaaaaatcatatcttcctatcttatcccactcatctgatgacttccaacaatgatgccaaaatacatcagctcagatgaaggcactagctcaggtgcccttgggtttttgccttgcaactgatccacttaagacacagcctctgaaaacacattgactctaaaagcaaagcctcctacactcaataaatccttgttggatttcagcaagagactgcagatagagaagtattgatgctggagctgtaaagtgccttagagaaaagacagatctggcccagtctttgccctcttgggtgttcacatcctttcttagctatcacccaacccagttggataaatatatctctttttgtctttccacatacttcaatcccttcctttcctgaatcatttctgttactttactctcaaccttccccattctgtctcttccttttcaatgcttaatgtcaggaccatccacagggtagaaggtaggggggtatgcagtggaaatagaggggtgaaggcaatagacaacagttagtaagacagcaatattcactgagcattgtctgtgccctgaaagctgcagtacatttgggagtcagattcacagagctgtcaactacctatgcggtgaatttgagggcctgaagtagggtctcccgctaaaaaatggcca

SEQ ID NO: 2877 - DNA, 1103 bp, Homo sapiens
ctattatctttcatggtgtctgaaattctacctgttaaagacttaacccttgtgattgaggcagcgactctatccttggtgttagtcaaggatattctattaaatatactctattatagtctattcatatgctcaagttaagacatcagttgtgttcctgcctgactctgtgataaatgagattccaaccttgggcccctgtaactgttcctgcttttataatctgcccaatgtccaattcctctaccacaggctctatgcctttagtctccatctagttactaaaatccagcttctgaaattcacacccatggatggagttcttccaggtatgcagtagctatacaacacatattcattgactgactggccagctaccttctactggtctccttgatgctgacctagaatggtgccccatatacaccctcctctgtgctctctcacctgcattcagcagcggcttccttactgcccacacctgagccctcctgccaccctccgtgagaagacaggttcaaaatgtcagccaaaccaccaccctgtttccatcttcttggctgattaaactaggtcattaaatctttgggagctcttctcttaaacacatattccatgaatcccctgctctaaaacttcacttttccagggtcagacaacaaggatccactaggcacatttagcaacgtgtaccagcttcctccctcttctgcattgccctctgcagctctccatgggtgttccagtgagagccccctactcctccccactgcccaggatccctgctgagtacaggaaaatagtcaaaactatgacagaggagataaggctaccagatcaaagggttcaggacaagagacgagtgtaaattaaggctggaaaagtaggatggtaccagatcaagtggacttgaaaggaagcagacaagtctgaatggcagattggtataagagggatgtttcaggaggggttctggcccaggtacaccatgttgggatgagaagggtttggaggtgagacgaccagtgagggtagcacagacccctttgaaactcagcagaaaggtagacctttggtccaaggggaaaaaaatactgaaaatt

SEQ ID NO: 2878 - DNA, 90 bp, Homo sapiens
tctggggcatccctgaacttttaaaaatccctggagcagaatcttacaacaaatcaacacctgacatagggtggtcacctaaatggtagt

SEQ ID NO: 2879 - DNA, 120 bp, Homo sapiens
ccctcataagtgagattagtgtccttacaaaagggctcaagagaactagctagccccttttgtctttctgccatgtgaggacacagtggggatgcagtgcctaaaaagaaaaagagagag

SEQ ID NO: 2880 - DNA, 21 bp, Homo sapiens
taaagcagcagtgtttaatcc

SEQ ID NO: 2881 - DNA, 108 bp, Homo sapiens
cctacttaatctctgctgagagaaaacagaaattgataagcacggtagtaaatggtactaatggaatggatgataggaagtaaactctaggccatttaaggaggaggg

SEQ ID NO: 2882 - DNA, 171 bp, Homo sapiens
ggagggcaaaaaccaagactttgaatttggggattttggaaatgaaaaacatgaaagtttgaatatttctaaataaccagatagatggtgatgtatccaaatgagagaggatgcctgtgttttgttgatttgggttttttgcattgcttatggagagggatgtaaagtttg

SEQ ID NO: 2883 - DNA, 795 bp, Homo sapiens
ttggtattacagagccctaaagtttgagcaagaggaactacatgttatagtttttcccccaggcccagtagcccacatctcccctttatgttcttggccaagtgctgtgtatgggaaataggaagaaaacatccatccaaatgtaggaaaatcacactgacaactgaggagaggatgggaagcaggaaaagatttgagacactagggaaaaaaagcaaaacagtaaggaggttgtattcatgaacctaaattccaagctgtttcccccagtgataagacagaggaaaaagacaaaatatgaatatctggactggcacagtcagatagactccaattgggttacctctgggaaaatagtaaaatcaccctgcagggatctcaaggagcctgagtctttgaattgagttttaacagcaacaaagccagattttttttctctggtctgcagttgtattggcctccatgatctctgaataagtcaagcaagggatttttcctgaagtgggaagcttttcatggctggtttcttgagagccttgaacacaatgctttggcaggtatgtggctgcccagcagggaatcttggagctttgagcagctctggcagttgcaaggaggcaggtcacacagcttcacaaatcttctaaaagaaaaagcaagagagtctaaatttaaagaggagaagcaacagctatggaaaagaggagaaaagtatcaaagatttttagaaaacagaatagaaaagataaattaacttcaagctcagaaagaagcaaagtaaaaggaggaattgag

SEQ ID NO: 2884 - DNA, 208 bp, Homo sapiens
tggaggagtttagaatgatgcccaaatttcctatccagggaacttgggttttgatagtgtacttcacagaaataaggactggtgggaattcccgaaaggttgggtggggatggagatcactagaaggagagataatgagctcaggtaagttttaaaagtgttgttttcatgcacctttgcaatataccactaaaatatatattaaata

SEQ ID NO: 2885 - DNA, 751 bp, Homo sapiens
ggaagagactggaggggtagtacttcagctcacagatgagccgtgggaaggagagactcatcctgaaagcatggcagcaggaggtgaaggctgatgctgatgagacaaatgtagacatggagcaattactgtttgtcttttcccgggaaaatggtaggtaagattgtccatagaaagtgaggtagctggaggagagctgggagcctggaaagacttggagaggtggaagaaaatgttaaaggattgccagagttgtacattgccttgacattggatgctataaaccttcatctatgccagtatatgtgtatgttgtgtgactgcctccagcatttctcagactctcaggttttgtagatggagctccctagatgttaagaagatatgaattggaagttgcaggacaggtctaacaaacagacaagggaacagaggaattaaggatgccagcaaggaagattgaaggattgatgtgccatgaaatttcatctggaatgataaagaaatgaaaccaggaaggggctgacagaattcaaagaaacatgagggatcaggaaactgcagagtacaaagagcaaaaacaagcagatctttaaaaccatcttaaaggacgtgttaagaggtagatcttatgttttctaatttggggtacccaaaatgtttttattgtgattattctaccctgggaaatgagggaatgagagcaaagacctagtatgtttatgaactgcaaatactatttttaaaaagt

SEQ ID NO: 2886 - DNA, 100 bp, Homo sapiens
caggcatgttggcgcttacctgtagtcccagctacttgggaggctgaggcaggagaatcacttgaacctaggaggcagaggttgcagtgagccgagatca

SEQ ID NO: 2887 - DNA, 341 bp, Homo sapiens
gtaactttctacccatctaaaactgctaattgcaaaagacatgccagttactggcattgttatataaaaaagctggaagcagtgaagccaatgagaaataagatcccacttctgatgaaaacggaccaatgagaagtaaactcctgcttctaacaacaattgaaagcaaaactttatactaagattggtcaaggacatgccagtgagttgtagatctagcttttttaggcatcaagttgtaatgttattcgattaataatttcctccgtgacagccaaagccatggtccaaaaggagtgatcttcactgcccagccatgagagcaatctgcttggagatgc

SEQ ID NO: 2888 - DNA, 162 bp, Homo sapiens
cctacctcttcctctcactggctgaacccaatgggatgccagaaaatggccatggatgcagtacattccatacaacatagtgtaaatatgttttcaaatcggaggtttgctgatataactggaaaatccaagaaaaaaaatcagatacagtacacgtctcca

SEQ ID NO: 2889 - DNA, 124 bp, Homo sapiens
ctggactccgtctcaaaacaaaacaaacaaaaaatttttttaatctggcaacaccagatctattttctgtagggcagcactcaactggaactgagtaactgcagctgctctagacaaggcatgc

SEQ ID NO: 2890 - DNA, 147 bp, Homo sapiens
aggagaggctggctttccccaccatggggtggcctgggggctacctactcgtagggcctgtgaatatagccctgcccgggatgagtttgatgccccctcagtctgctggtcttccccaaactataaccccatgaggagcacaggaac

SEQ ID NO: 2891 - DNA, 1998 bp, Homo sapiens
tgtggagcactggtggggagagggggagaagagatgaggaagggaaggactccggtttgtgttttgtgggggctaacatgaatgggaaaggaggggacagcctggagcagcccagccaagcccaggtgcagggttctgtgcctttcttcccagagagctggagagtgcaatgggcaggtgtgaagtcaaggcggagggcagcagacggggaccagggctcgctccagctgccttctggggcaggtgcagaggggtctggagtagctcccaaagatggggcaaggtgggtccgagtggccaggaagctgagggtggtggtgcggaagggggtttctcagaagatcagggggtgcagggttgagggcagcagcagacttgcggggcctgcagtgaggaaggagtcatgtgcaattctgaagacaacatctccggggtggcaatacgaaagagagggtgccacccacggctcggtgtctctgccctgggtctagggtctgagttccggagtgatggagggggccaagcgtctgtgaaacttggggggtggtctgggtcacgactggggacgaggagggtctggaggtcccagccctgcttgtggatgcgctgttgttccaccctctggctctgcctccctgtctgtgaaatggggtcccacttccttgaggcctcagtgctcaggatgcaggggagatgctggcagccgaggagaggggcaaatgctggctgtcaggggctttctccaggatacaggacagctcaccctgagagtgccagggagggttagatgaagcaaatgaataggcatggttatgatccatctccccagtgatccagaaaatggcatgcaggcggccatatggatcagtcaccatctctgagtggctcggctgcctggcggtaaacaccgggcccttcaggcccccaggtgcggaccacaccctctgcacctgctccatgagtgcccgtggtcatggtgggggttgagggtaggggtctggctgtccccatttggccctctgtgcacctagacacagaggctgtcacagtggctgccacttgtgcccctgcaggccagggctcatccaccccagggccatgtccaggcatctgcctggctgaggtgcactggggctccactgcccagccgggacctccagggagcaatgagcctgggataacattcaggagacccgagggtgctggctactctggtccaagcccctcgtccctcacagcgtgctcaggataggacccgcagtcccaagggccctggcctctactttcaggagcctggaaccccgggctcctgctgtccccggccctgcagcagtggggcgcttcccttggtgtcacctctctgggcacccccatccccaccatgcccagtgaagctctcacctgtgtcctcccgtccttgccaggcccttcgcctgaagtcctagctccagctggcctggggcagccactcggcaccttgtatcccgggagctggtgggcagggactggggttcccctcagcctccatgtgcctggccacctggggagcatatgcaggcgctggaggatgcctggctaggagtctatcagctcctgtcccgacctgcagcggttctccctgatgaccacagaaacattccctgtggcaggtggcaatgcttagcacccagagcgagcagtcagatgagatatgggccagctgcagaaatctgggtgctggtgtgtaggagacggggaggccccctcacagttgtctgtgtctgcatgtgtgtgtacacgcatgtgtgtttgggacaggtgagtctgtgcttctcccatcccaggccactcgcctcctcccagggctcagcacagtctcctttctccaggataagagggccctggggtggcgaaggagctgccttgcggtatggaatctgcctctctccacccccttctcttctagtcctaattctccttggacatccatttttccggtttttgttttcatttaaaaaa

SEQ ID NO: 2892 - DNA, 200 bp, Homo sapiens
aactgtggtaaaatatatctgtaacttaaaatcgagcatcatagccattttgaagtgcagagttctgtggcagtcagtccatctgcatgtcaggcagccatggccactgcgctctcctgcacgtcttcctcctccccaacaggaactttgtccccactaagcaccaccgcccatttctccttcccagcccctggcggccc

SEQ ID NO: 2893 - DNA, 101 bp, Homo sapiens
cggcgcctgttttccattctgtccagtctcgtggtcacaggcgctcccaggccctcctgtccatctgtttggcgtcacttttaggctggaatggaagcccc

SEQ ID NO: 2894 - DNA, 1265 bp, Homo sapiens
ccagaaccagtatatttggcacaaaatgcccttacgtcacttggcgggggggggatgtaggaataaagtgactcttccctgtcgatgtagaccatttgggcatccggcaaacagagccttcccttgacagaacagatgccccacctttctggtggccaggggacaggctgcctctcctttcccgcccgcccatcagctaagtgcctgtcttccaggatggtaaccaggctgtgccgtaggaggccaggtggcagtggccttgggctgtgtcaccagtctctagcctgaccacaaagggagcggccctgggggaggtgcagctgggggacaggttccaccgtgggagtcagaaaacttggtggttccccacacaccatggcattaactctcttgttttaaagaaacatactgcatatcataaggatctctgtctgtgagtcagcgaattgcacgtgcacgtattcatcatgtggcgcttttccctctgcatgtcccatctttggggacgtggtggagcgcctgtcgggtgtggcgggaacacgtgtgctgacctggccatgtctgcttagatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagaggtaaggagggactttgagtgtgcctctgcatgccggttcccacgtgctcccgcctgccctccatgagcctcccccgctccagaggacacagggcatctgaaggtcagccaggctgtgtctcccatcggggctgctgtgacaagggtgaatggagcggcaggtgatgcggagccatcccggtctggctctaactgagcaaccgggagggcacaggctgctgggggtgctccctggacactacttttgggactggacctgtatgtccagttcagaagctctgcagggcacacagctctggccaccctggcaggcttgcctctctgcccttgctggccatcccctcccacagccaggctgcttgccctgtcccacttcactggctgaaccccccacagtccagttctttctggcatcgcttccacggcagtgtgaggatggtgtgggggaggtgcaggttttcctccagagctcacaaggaggcaggatcattgggaggggggatggtgctggggaggtggcacatacaccgggggaggcctggccagtgcgcagcgg

SEQ ID NO: 2895 - DNA, 48 bp, Homo sapiens
ggatgtgatgtatgagtgtgggtaagtgtgggtaggtgtgggaaatga

SEQ ID NO: 2896 - DNA, 1458 bp, Homo sapiens
ctgtgggtgtgtgtgagcatggggtgtcaagcatgagtgtgtatgtgtgcacggctgtggctgtgggtctgtgagtgggtgtgaggcatggggtgtgaggagagtgtgagtgggtgtgtctgtgtgtgtgtaggggtgtgtgaaggggtgttcagcacaaaggggctgcaggctctctgggaagcgtggtggccgcacgaggcgggaggctgagagctgaggagcccggcctacagaggggcccgctggggaccgggcagggaatttgggtctggggacagcagcagcaggccgggccgtctgtggtgctccccctggtggctctgtgaggctgagtgcgtggcgaccatccttgcagcctgtgggtgggcgggtgggtggaggggtctctagttcctgttcttcggatgaggtctccaggagccacatcgggacactggtattttgtgcactgcagggtcggctgggagctgggaggcctgttttccctggactggtgggggcaggggtctggctcaggaggaggaggggccaggcggacaccagcctccctttgatggcttcaaagaaaggaaaagccagtgttcccaagtagatgctttgaagcggccgcccccacggccagcagccccacacctgtgaggaaatccacccgtggaggagcgggcgggagaacggggaagaggcaggaggcggccggggcgttggaatcctttcagccctgccgaggttatggtgcctgtttccagcagctctgagcccacgcggaacatgagtcgctgataaacaaggcttgcagttgcgaggggcctcggggtgggtttctggttgaggaacgccggggaatggctgatggaggaagcccctgccgggagcaggagcagcggaaacctacatcggccacacagatcccggcgggggagggagggcaacgctcagaagcagagctgcgcgatgtgcctttctgggctgctcagcccagggcccgagacctgcttgcctgaggaggggcagatgcacggcggctgcaccccgtggggaggccagcatgcctgcggcagctgaccctggcagtgcgagggccccccatccggaggccgcagcctagcacagtcccgggcaggacaggggagagcgtcgtgctcaggagaggagaagtgggcagtagagctccctttccgttcttgaagcagacgtttagagtctgctccttcccagtgtccgcaaagaaggattacaaggcgcgccacccacacggttggtctccctggggcggtctgaggccttgcttgtatacccagctcctttggagtcagggctcgaggccaggccccaaagggtcatttgctcaccgatccccaaaggctaagaacttgaggtgccctgggccccagcgagcctgttcccagcccccagcacactttcctggcccgtgtgtgttttgtaagaaggggtgta

SEQ ID NO: 2897 - DNA, 2625 bp, Homo sapiens
ggggtgcgtgtgtcttcccccattgagctcctcctcagtgaagcagagtgcatccctcgcagtttctgccgaggcctggccacccccagccagccccagtggatgggcaaactgttgtcaccactagaagtccaatttctcacccctcgggtgtcagctggactggaagcaaaactagcactcaactgtattgactcctctggagccaggggtggggacctggagtctcagtctgctgcatctggaaggcatcataagtgtccccaggcctgggcaggctggccttcctccttcactctaggagatgggcatttgaagcagaactctggggggtttgcctctgtcctttgctttcacctgattgtgggaggggaggtgggagggcagcggctcagcctcctgtttctgtccgcagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgaaaagccgtgtgtgtgactggtctgttacctcagcggcgggtgcccgcctgtcctttcattcacagcttggatgcggctctgcaaattcactatgcggtggcagccacagctgctctgtgctcctcctggatcctgaaccttggaagctgtcactaatgagttcggtgggtgggtgctctgggcaccaggtgtcagctgggcaacgccccgctgcaactggaggtgccagcaatgctaccaggtcacggggtcagcgccaggttcttgacccacttgccccagcagggagacacgtccgcagagcactcactaatggaatgagggagccagggagccttgggcttcttcagatttcaacgtaaatggcccctgggaaaggtgtgcatgcgtgtgcgtgtgtaaaagccggaccgcccatcccagcaccctgtctgcacctgtgggtcctttgcagcctgtctagagtgacaattctggcagctctgccagcacttacctttcttcatggccaccgttctggtgtcacctggtgtgggaaagccaggtagcaagcacgggctttgttcagaggcggtggcctggggtccagctgggttaggctgtgggtcttggatgggcaggagccctcctctctggcctgcccacagcagcgtgagctccttgctgtgggcactgaccaccttcacggcccaggattcttggggaactgcagagtaaggagaagacttactctcacctagccgcccagagggtgtgggccaagggcttgctccagcatgaccttggccatcaggggcatataaaagagacggcctttcaaggcgcacaccagctttgtgcctccctcttcccagaaagtatacatggtagaggcaaagaaagctgttccataggagactgtcacagagagctgcgtatatgccgaaatgtatatgcactcgctctgaatgaatatgctt

SEQ ID NO: 2898 - DNA, 1589 bp, Homo sapiens
tacaattctcgacgtggccaacaaacaagaatgccagggatggccacatccttggggaatgaagagaaatgtcgcctgagtcaaagctggagggaacgggattccactcaggaggccaagggggacattcctgccgtgcccaggacaaggcggggaagcaggtcccggggagagagccctggctagctgaggacatgcaggcaggactcccaccaaatcatacacatctttaaaaaacctgtatttaaggaaacatctgagccatggcctgcattcctcccagcagcccttggaggccatgtccatggaggggctgccatggccagcgtggacgggcgtgggtgtgtccaggccctggccctccccactctgccccggagttgaccctctccggaaggcttctggaagcacagctgagtggcatgggtatcccaggctccccggctggctactgcaaggtcctctcaggaccctgcccctggccactggggtacacagcctctcagcctgcctctgtcccagttagacctcagagacacagaggccagaaatacttctttttattaaaacacggatcattattaaaacaccttgaggtacattaaataaatacagcctttccagttgtacagacaggtctctggtggcttgaaaacaatttcctataaattctgccttagcagcctctgagagtcagcatgggtggggagaagcatgtgtgtgtagcgagctttctgtggcctggtgtgttacaagcatttaatgtggatcctcatctccagccaagggagacctgaagtccttgcggatgatgctcccccttctgcgatcttgcttgccatagagttggggtccatgttctccccactcagcaaccttgtggcccccaggctggggtcaacggtggtgtcacagcaggtgccaaccccctttgggtctcaggggagggcaggggatgcccggggcccagctgagttggagaaggagcgtgtcacccccaaagcagccacagttggcccatttcagatcccagatggaacatgattggagcgggggaaagacgcatagggaggggaagcagccagctttctcctgggctgtgagctgacgtgcagcccggggcctgggctcttgctgctggtacccggatgccgtggagccggggccaaggggaccacagcttctgggtcaagttgccagcacattccctagtctaccagcacctctctcttctggggaccttcccaggaagcccagaacctggaccctcctagagtccatgagtggccctgagcagcggggctgatgggggcaccccaccccgtccctgactgcctcatttcgaaggggcagaaggttccagcccagcggcatcaagttgggtacagtttccgtatccacaaaacagagctgccaccagcgcaaacccagagctgggtgaaggtggggtgcaggtgaggggcctacagggaggcactgctggggcagcagccccattggccattgggaccgggccctgctgcagagaagggaaggatgctgagcagcaggctgagggggtccagtaggcctctgccccggctgcatga

SEQ ID NO: 2899 - DNA, 664 bp, Homo sapiens
ttctggaactctctacctaagcccatggtggaggggggctggaggacacagcacaaaaatgtgaggcaaacctgagaagttagaggagaaccacactccacactcaatgcactggcagaacatttccaggagggaagaaggagtctcgtctcaaggactttgttctgtcaacgatgctgaagagctggctgcaactatccaccttcacagctgaccctgttcccgcctgctggtgccctgtccacacccacttgacaaaccacaccctttcctggtcactaaccagggcctgaggagcaaacagctctttgttctttcccgacattgttgcaggctgaacactgaatcaaaacacatgctggaagtcacaaaggtgctgcagcacctggaccaggttaggttcaggtcagatccagatggaagagccagacctccaccctgaccttcacagagatcccgcttacagttcctgccacattgtctccaacattcaatgaagtttttctgagactgaaaaaaagactgacagcctccagcaaaggtttagactaatttggataaagcttagagagcacaaaaatacgtaaagaacagagcaatttcgtgtgctttcaggtcccaaaacgaatattaaaaacagataaaatttacttgggtaattcac

SEQ ID NO: 2900 - DNA, 227 bp, Homo sapiens
tttgtctttaatcccatcaattatggagggtaaaaataggacttcgttctagttatccagataaccatctcatttcttggcttcacttgactgaggaagacctggcctgaagaaaatatgggtcattcagtacattttccttgtattaaacgattagggtgttcatttatttttctaaagaaataacatagttaactgatgtggacaattttactttaaatgtgatc

SEQ ID NO: 2901 - DNA, 383 bp, Homo sapiens
gatctagtgaaattcaagattcaaaaagtaagttatttcagtatttttgtatggatttgctttctttacatttttaaccatgacatcagagtttaaggtgtttttttgtgttatctgcaccacattttccaatagaaatgtaggctttagacttctagaaggatatggaagtttcagatcagtctctcaatagggattcagtattttttttggtgaatatgggcagaaggggcagtcacgtgccagaaacttacaggagatgcagagatggcttatggaaatttttttttaactgttaaaattttcaagtcccaaaaggtgctacatctcaaggatccatatgaaaaaaagggaagtgcaagatgctttatggcagagcgaat

SEQ ID NO: 2902 - DNA, 204 bp, Homo sapiens
ttcctggggtatggcagacactcgatggaaactgatgtgggtttctctggctcgctgtctaaccaggatcatttcccacgtggcacaaccccaccagcactacactgctaaacttgccccgtcagcaggcagcttggggtgtatctatttagccatttcattcaacataggtgaaccaaaacaaagcccatccaggagctatct

SEQ ID NO: 2903 - DNA, 100 bp, Homo sapiens
ctcacctgctggccccctctgaccagccactctgagtgccacatgggtcctgagcatgacacattcattcctcacctgcgttgcccttactgttgccctg

SEQ ID NO: 2904 - DNA, 123 bp, Homo sapiens
tacagagctgggtgcaggctctcctacatacatttgcaattcacccaggcctccccatagcatgcatcaactctaatgagtaatatttggttatccctaaactttaatatcttgctccctctg

SEQ ID NO: 2905 - DNA, 795 bp, Homo sapiens
tgagtttctgacaaatagggggtccaacatgactttgtggaatggctgaacagaattggttcttttaataaggcttttctctaaaataagcagcagccccctaaagggcaggaaactgatcacatgactacagcatgttccagctgcaggaacaggagtcaaaaagactcagcctgatgaacataaaatcaaagcctagaagagaaaactaatgaggggcaagaagaacttgaatccaggcccaagtcttcaggccttagcttgactgttgccttgtccttgctgccccttctggtggacctgatgcaccctaaacactcctgggccatgagctaaggctcaaagcatattggtcacatgagtgtctgaagacggcctctgtgagtccctgcagatttccttacacatttcacaaggaagggcaatgccttctttgtgcctcagaccagaagagtgaaggttgacagccttggagtaattcccaggaaagctgcctgggagaaaatgccaccatgggctttcttcctgatgttggtttggtaggcaatggccccaagatcctcctgaggcctctagccaggagggatgtgtgggatgcctctgccagtgtttgccccatgcaagttccatgcagaaaagattcatgggtcccaaggagacagaactgagagcacccaggctagagagcagagatgcagagaacccagcccacgtgtagagaaagccccctccctgtcctatggtaaggagccctcatcccccaccaatgcagggtggaagatggagatggagatg

SEQ ID NO: 2906 - DNA, 454 bp, Homo sapiens
ctcggcctcccaaagtgctgggattacaggcgtgagccaccgcgcccggccggagatgttttttgagaacccaccaacctcaatcacagactgagctctgaggcatggcagtcagaggctgaaaacatccacagagagtcaccagagtcaggatacagaaaggaaagatctcgccacaggtgtgtcgggttaaggagagggtcaggggaaggcaggcaatgcaaggagatgagtcatgcggatgagccccaaccagaaaccatggcctggcagccttgaccaggaaagcctgtcagaacgccatcgtgcttcactgaatattctctgcctgggattatattcaaattaaccttattatagtaaactgcatttctagtgcacatttcagagtttgagtttaatcattcacaaataatctctttttctaccttaaatttgaagttaaaaaaccctt

SEQ ID NO: 2907 - DNA, 172 bp, Homo sapiens
agcccttcaagctacccagcattttcaagagctatatgggattgatggatatttactgtctgtattataatcaaatcccagtgcattgccaggaattggtagaactaagaactttcaggatgtagccttaagtaggcgtatgcctgccaaggtgcatacacattgcattaaa

SEQ ID NO: 2908 - DNA, 831 bp, Homo sapiens
ctatgacagcagcaggattagcaaaacatctcaagaacaaagagatggagttcaactctgttctacacgccaaatctgcctgccccctcctgccccttaaaaacctcctttgtaaaaatatatgccccttccccctaccccaggggactgcttacctggcgttttacaggacataggtaaagaaagccagaaaggcacagtgacttgggaggcaacaggtggtgtacaggacctgccacagccccgaactgcctcttgccaatttcaaaatgaagagatgctgtttgaatgaacaggagcaaatgggtcttctccttgtcctcactcctcactttcggcttcactgctccaaaattaaaaacaaaagcaaaagcctgtatccaggaggacgccatgagagtgcctgaccgatcttggtggacgttcccgccagagctctgtgccaggctgccggtgctgtttattctcccttggcaggcccgcagcatatggtgcctccctcacctcttcggcgtcttccacgtcacatgcagtgagagactccactctcctggggggtgtgtcgggcccctcactgggcctgttgctgtatcatctgacagattacaggccgcatattgctgggctctgcctctgttgggagccagcttagtcatttaacagttcattcagagagggaaccagggtgccctgtgactgctgacgtgatggattttgtctggggaggaaaggaggcacagccctgcaaaagtctacaaatcccatgggtgggccaaactttgatgacttgacctagtcggccccaatttatcataataaaatgaaaataat

SEQ ID NO: 2909 - DNA, 251 bp, Homo sapiens
cttgactcacaggcagcaagcggcaaatttgaacccagttacgcctctccctctgcagcacttgctatcatgctacctcttccagcatgtcttccaaccgttattagggtaagctttctaaaacgtgtattttctaaaatgcaccaaaactaattaatactaatatgacttttgtatttaaaaaaaatcacttattcatatctacagtaaagcattccagagtgctagtggttcccaaagaattcttcttg

SEQ ID NO: 2910 - DNA, 125 bp, Homo sapiens
tttttttttaaataaaataattcttctttcacaaaatattaataaatgtcctgccttggcgagtcttccaacaaaagtggctttgtggccatctgtgctgggaatacagggttgtattggaaatg

SEQ ID NO: 2911 - DNA, 207 bp, Homo sapiens
cacctggacagcacccgaaacgctggcctctcataacctcgagcttccatcttaatttccaggccctgcctggtcaagtttcccccttgttattcagcaggaacattttctcttgaaacggacggttggaatcctggcctaaactcaggttctccctcctcatcaatgtctctctccacctctcctactagaagccctacctccaag

SEQ ID NO: 2912 - DNA, 441 bp, Homo sapiens
gagcatccttaacatcccagcaccccctctcctgctgcaattcagtccaattagcccctggcccaaaatctaattgtgtgcaaagcacaaattaacactaaaccggatcagtgttgtttctttttaatgctgaaacagttcagggctcactcatcctacttcatcagctagattgcaagctccatgtagggattttctcccttttatttaaaccaccaggctgccccttttagtggacctgatgcgccctaaacactcctgggccatgagctaagactcaaagaatattggtcacatgagtgtctgaagatgacttctgtgagtgcctgcagatttcctcatacatcccgcaaggaagagcaatgccccatgtccatgaacggggaccatgactccccactctggctgcgaccttcttttttattctcaccttgctgaaaa

SEQ ID NO: 2913 - DNA, 220 bp, Homo sapiens
cctgcctgccctgcccataaatgaattaaggttttgcatcctgaatctttatcctctggttgaaatgttcttatcccatggttagcctttcaaggccaggttcaaatgctcttcccctcactggacattcccttatcacatcctttacatgcctccctcctgaagagtctggccaagtcacatggcctggcaccattactaattgcccactgacccatgg

SEQ ID NO: 2914 - DNA, 167 bp, Homo sapiens
gaccctatggagtgagcaggtcatgctgcgtctctttgggcagcatttggtcacaagatggtgactgggcacctgtgtgcttatcagaagtcacggcaaagttttgcaatgagaaacaggaaatgaaggagtccgcttttaatttctagggagagatgctcagtatt

SEQ ID NO: 2915 - DNA, 1359 bp, Homo sapiens
atctgagtttgttgggctagacacattggacatgttatacccatgaaccctggctgacaaggtgccagccacacagccaatctcccctactgataagataaaggacttggcctatcacatatgactctcctgacaaccacttgatggttacctagcgaaggaggtaattaacaaagaatcttacaagaaactcgtgttgctcgggcaaatgcccggcctggacatcccaggtccagaggagtggaaagaacccagccagttccaacgggatctgcaacgtactttctgacctgttgttctgacggcaacagagcaggacactgtcatcgcctgccagcctccaagtctctgtgacactgtctcaaaacagtctaaagctttaagtcccctcaaacctcccacatctgccatgtggctggatcactccaaaatcaggacatgtccctaaccttctattaagggcattcgactttataccatgtcactgagcatcactcaatcctgcctataaatatggatgctatgctaacaagacttattgctgatttaatggcagtgagtacaggctggtgtgctgcacacatacacagagaatggtattgaaaaatgggaatgataattagagtttaataaatggtaatttgctccttgctgctgtgtgtgacaggggttggggagggatgaaatagaggggcccttccagaaagtgaaatgtggatagaacgtatgccatgacagctttattttaattttcacattgcccaggattgaagttaatgctcatttacctacagatccttttccctggaaatcacctcttgtggaacatgagtggagaagacaattagacaagaaatatttatcactgggaccaaattttaactagagtcatagaatgaagaggtcagggctccagagacaaagtgaagcagagaattaaaataattatctggatcattcaggggaaataaaatcattgtttttgcttgagtgagtgtctgaatgatctaaataattgtccccaccctttgttttggtctggtagtgaagacctggccaatcgatccagtagcaaaggatggaagttggaagtttgtggcgagaaaggacaggaaggctgagtaagcctgaatccccctggtcctgcaggcctgagcattgggcagaggctggcccagtccagagcttgggctggagagggaaggatggtattcctggaagctagagaccagaaagtaagcaacgctgaaagtcgcatgggaaaccaaggtcgacaaacccagaatacagccagaaggagccaggtttagtgagtgaatccaggaagctaaaagattaagcagaacagaatcatgaggg

SEQ ID NO: 2916 - DNA, 359 bp, Homo sapiens
agttaggaaaggttaaacaattgactataccagaggtttgcagcttcttggactccactggccaatcaagagaagtggaatttttctggggcagtggcggtatgctagtgtgcaaatggaaggtatggtgttattcagcgggccctgcaagtctccccttcccagaaacaactactttatttctagatatagaataataataatagtaaaaagacagctactttatgtaaatgcatgaatgatccattgcttgagatttattcgtggcctacttgtgtgttcatttttcaaacacaaattttccttggaggacaaatcagtagtttccaagcttactatagaaattaacaataactaat

SEQ ID NO: 2917 - DNA, 200 bp, Homo sapiens
agtgttttgtagattcctcctagttccctcttttggattgtttgctaaggtagaagccacctgccacatcactaggacacacaagcagccaatgcagatgtccatggagtaaggaactgaggcctcctgccaatagctgcgtgagtgtgccaccttggaagcagactgtccagccccagtcaaaccttcaaatgactgcg

SEQ ID NO: 2918 - DNA, 35 bp, Homo sapiens
ttatacatagtgaatactgttagttccctttcctg

SEQ ID NO: 2919 - DNA, 100 bp, Homo sapiens
ttcttataaaaggtccagttttccccttttttctctctcttatcctcttgccttcctccatgggatgatacagcaagaggatcctcacaagatgctggca

SEQ ID NO: 2920 - DNA, 30 bp, Homo sapiens
aaatatctctggaagagtaacaaataccag

SEQ ID NO: 2921 - DNA, 268 bp, Homo sapiens
actactaaattttcagctcctattttggcatgagacaagtggtgggtggttcagttcggctttttgtaactgctagttctgtcccccaccccgccccgccaacacacaccatggatagtaccacgtgaaagccagtcctcctgcccctcatattcatcccttacctcccaccctaattaatctggtccagatcctcattcttgccatgaattttagcctcctctcttagataggatttacatgttcttgcctatagtgggtgaaattg

SEQ ID NO: 2922 - DNA, 200 bp, Homo sapiens
ctgaagatgagattatccgggatttagggtgcgtctaaatgcaatgactagtgtccttataaaagaaaggagaaattggagacaaagagacacagggggaaaaccacatgaagacagggtgtagagatcagagggatacatctgcaagccacagcatgccaggattggattgcagagccacagaagcgaggagatacaca

SEQ ID NO: 2923 - DNA, 84 bp, Homo sapiens
cttcccttcagaggcccctgttcatctcagccctaaacccagcagcagtctctggagtgaggttggggaattacaaaagccgta

SEQ ID NO: 2924 - DNA, 38 bp, Homo sapiens
tttacaaagccacagccttgtggttgttatagttccca

SEQ ID NO: 2925 - DNA, 176 bp, Homo sapiens
ctagatccctcccatgtgcagttcacagtagggtttccgctcctacgagactctaatgacgccgctgctctgacaggaggcagagctcaggtggtcatgctcgcctgccctccactcagctcctgctctgcagcctggttcctaacaagccatggactggtactggtccctcaggg

SEQ ID NO: 2926 - DNA, 579 bp, Homo sapiens
aggctgctgctgaggcttcactcatgggacagcttcctggaaggggctggttacctcaagtccagatcattcagagggacatgaggatcacactccgccaatgcagatgttgagggaccttccctctaagatgtgaaaaagaccccaagcaaagttcccaatgtgccctctctgcaccttagaaaaccacaaggaaatatggattggttccagaaaaaggcagatgccacaggcactgggccctgccttcatgattgcatcaaaactgttcacgcagctgccttctctcaattatccaagagctgttagtcttcatgagtcttgtccaaatcttttgccttttctcttcctttggctgttccctgggatcgtgatgattactgctctcatccaaggtgaacagaaggtgaaattcaaaccggtcaggctgctgatagaatgtttggaaagagaaggcaggtgaagctgctgcctcagtggagaccctgaccttctacctgctgtccctcccactttctcaaaggcaccaatctatgctacacctctgggctgtgttcacgttgcttcatcattccatgg

SEQ ID NO: 2927 - DNA, 100 bp, Homo sapiens
cacgctttccctaggtcaggaaggaagcgagggtgcttgtccaacagtgccagcattccagacagtgcagtacggtaagaaaggggaatgcaaggtatgg

SEQ ID NO: 2928 - DNA, 712 bp, Homo sapiens
tttttcaatggatacagaacctagaagttggccttgcaccaaagaggatatgggaacagaacatcagtatgaggaaagatgttcctccttctcaggaggcagagtggctgtcccatagccacttcagactcaccatctgtgtgttctccccttctcccaaagctgtctactttcttaattcctgtttcttgttgagggccagcctccctgagcaaggcagtcagcctgagctgctcttcgaggtcttggatccggagcctccacattcagttcccaagtccagttgatgctcttttctagacttctgaagatttcatgcatttgcctcttcctttctgtcttgatgcctgctgccacatcatccttcacgtagaccttgatcccagttctttcccccacatttgacccccaccactctgtccttagaataatgcctcagttaactctgttacctggacagggcccatccagaatgaagccgggactcctgagcctggctctgcatgccctcttggtggacaggaggctctctgcttcactgtgctctcttgatgggacctagagagctcctcaccccctcctccctctccagcccttctcttgtgtgtgtctcttccattcacaggcatttgtctttgctcccagacccatgtgcgagccacatacagttccctcttcctggagcgcttctcttgtggaaaccactagtaaa

SEQ ID NO: 2929 - DNA, 134 bp, Homo sapiens
tctgcagtctcctgtgactgcaccacatggaccctgcattagtgcctctcagtagcatgatctcttgcagcctctctccctgttatgctgtgggattctttaggaaaggaatcctcaccctccttgtgtttggg

SEQ ID NO: 2930 - DNA, 1018 bp, Homo sapiens
ccaagctcaatgagtagtgatgcattttcatgagtttttgccaaatgaatacacaaattctcagtgggaatgtgggagtcactgtctgtttagagaactgtagctcctgctgcagatgggcagctctccggagccctgtgctgtgccacgaggagcagccgtaggccgggctgtgcagagccttgtctccatctaaggagtggatgctttgattggtaagcagtggcgaggcacggatggtcactaaaagcaacgtactagaatgaggaggtgtttgtcttcggaaatagcactgctggggaaggtaggttaaagaatgttggagctgagctcaggaagccacggaagaggctgcagtcaggacgcgtggtaagagggcagagcgaaggagcttcaggaggggggcactccatgtctgaagtggggttgagaggtttgagagcgtttgggaggtagttgaatccagaaagtgaggaaaggttggtggtggtgatgatggctgtggaagagtagctctcgtttatttaggactgactgggtcaggcatgtcacctgggtgccctcgtgtcatccttggaccaccctgcagtgcttgcaaagtgaggaggctgagtgggaggtctttcccttctcggttaaggtatccatagggagaggccagcggggccagacaggccccttgcagatgtctcagcaggtgctgagggacagggaggtgcaggctgttgagggagaggcgaggctgggctgtgggtcgcatgtgggttgcggtgaggacacaaacccctttgtgaggacactgagacttgagcccggggctgcggggccgtggacaacagcacctcacatcccagagggagctctgcacttgcagctgactccacacccagggcctgtcacagccgcccagcaaacatactgagcaaggactggatggaaaatgagatgctatttctttctttagggttctttgcatacttgcacagtcatttaaaatcctaaagaagtaattgttcgc

SEQ ID NO: 2931 - DNA, 334 bp, Homo sapiens
ttaaaaaagtggcattaatcatagtcctgtttacaaactgcataggatttatgcctcattacgattccccaccctaaatcatcatgcttcacactaagagagaaaagtctaaaggaaatactttgttatctcaatctgctaagtagaatgtttttaacttagcacatttgttaaataatttttcagagagctgcttacttgggcacacataatagaggcaaacttggtacttaccctaatatgaattaatgtaaggtttcattatcttttaactgttggcagtgatagaactaccatttttcatctcacatttttgctatttaaagcactcata

SEQ ID NO: 2932 - DNA, 1609 bp, Homo sapiens
tgtatgaagcacaaatgtataaagcacttgtagaacttcatgatggtagtcagagactgaattgttgctaactgcattatttaatatagcctagtgttttatgttaattctacttatttaacaagagtagcatgacaaaacaaaaaggtttaaactgcctctcatgtaattttgatgattttgtttccacttagatttatgaaacttggagacatcttttcaaggtatacagagcacagccagtttaaaggtgcttcataaaactttgtggaagccaaaatctatagaactgagaagcatctcaggtagatagttagctgctgtttggaatttttaaaactttattatattcactcttctaagagcatttatcaaaacaatctctaaaatagtaattgtaagctctattttccttgtctttgaaagtaagcgctgtgtcctgatggaaggctctgagccagctgacctcttgagttctgatcctaactgattcactttgtgctctaatcctcacgcacttagagggtaccatagacatgaaaatagtttgggttatattccagtttgggttatattccagtaccatgtgtgccaaagaacataaaaatgagtgaatatttttatggatattttgcaaccataaaattgggttttatggttttattgcagtcaattgcaattttgtgcaatgaatggctgtgtcattgttcatactcagatttataacgtcagcagtatccgtggataacccttcttggatgtgctgtgaaataagtgcagaaacctccctgcccccaccctccccggggacaaggtgaaagcagcacgttgtgaaataagtgcacacaccccccggggacaaggtgaaagcaccacgcgtggcaccacgttgtgaaataagtgcacacacccccggggacaaggtgagagcaccacgcgtggcagcacgttgtgaaataagtgcacacacccccggggacaaggtgaaagcaccacacatcgcagcacgctacatacatatccagagggtatttgagcttccctgtgctactttgcttctataaagccaaataaataaaacatatgcacatgtaatatgtgtatttttaggttaaatgagatctctttgtcacctaatacatggcccaacttttctggcagtcctcctaagggaggactgtggtacttgaggagcaggcattagggaagcacattcagatagcccagtatttggaaaacactaaagaaaagccatcctatctttcacagacctcctgtctgtcattccaagggacacacatacatgctaaggattaaacacatctggaatatccatttctgttcagctaaaaagacttaattttttgaaataggtttttttaaaaaattaatggacaccctaatttggggcttgttgatgtctttctcaggcagtgttctatattgtaattataaaggtggtgactcagttttctagttttatgtccgcctctttcagagcaggcaaaagttgcattcgttccaaataacagatctgagctgaaaggcaatgacggactttcttcatataactagagcccttctcattattaaacgttgttagaggctg

SEQ ID NO: 2933 - DNA, 840 bp, Homo sapiens
tgttataaaggtaccttgacatgctagggagaaaatatcttgttcttcctattaaaatgaaaatagtagcaagtaacaatcttaacgctactttgtattatacagttgggcatcccagctgcttcagcccatgaatgtgcagcatgcctgcatggtaggaaagctgggtgttcccgcaggcctcctgcattaatgtgtttgctgttgtcccctttatcctaggaaccctcacccagaatgaaatgatatttaagcggctgcacctgggcaccgtgtcctatggcgccgacacgatggatgagatccagagccatgtcagggactcctactcacaggtaagtgggttcctcctgcacggggtctgcttccacacacatcccgcgccatgagtccagctgagcctcgtgtgttcccatctgtaaattagcacgcttcttggtggtcttaacatcctgctacttcagtcgtctgttcgaatatacgaatcaggaaatcgtctttgatgagcatttgtacatgagtgaaatcgtagaaggcatagtgtgctgaagtcatttattcatatcacattttactagtgagttatttgtaaaaaattattcagtaaacattgtagttgaagaatgttcagtaggatactacatcaatatgttttctaacagttctgtttttctctataataaaatgttctcatatttttaaaggtaaattctttttttgccttttcggtagataaaagtagacaccatcgtgttgggaatctcgtatctgtcattcacctacctgtcatcagtgcccaggtggtgatgtttcatctgtaggtgttcttcattattatta

SEQ ID NO: 2934 - DNA, 51 bp, Homo sapiens
ctgcctttcgttggggccaaagctccctaaagttctgagaacaggaattag

SEQ ID NO: 2935 - DNA, 115 bp, Homo sapiens
tttggatcagggatactcaacctgtatttgcttttaaaacaggatttagcctagaggctgtaccacttgccagagattttgcaggcagtgggttgtgtatagagtctgtccatgg

SEQ ID NO: 2936 - DNA, 100 bp, Homo sapiens
catgtgtatcctaagaagttagcaagggaaatttaatcaaatgagctacacctgcttatggaaatgcagatcttagtttttcttttttcttttttttttt

SEQ ID NO: 2937 - DNA, 148 bp, Homo sapiens
ggtttttcttgagtaagaaccgagcaaggtgtccccaggttgcaaaataacaagttttaccacacctggagataaagttaccaacgataggatcaagtgcactatttcacctagaaagcttgagaaaaattatcagcttcatctgttc

SEQ ID NO: 2938 - DNA, 34 bp, Homo sapiens
gcaggtaagggtcagagtgggagctattttgcaa

SEQ ID NO: 2939 - DNA, 34 bp, Homo sapiens
attatggggctggcattccatgttgggcctttat

SEQ ID NO: 2940 - DNA, 351 bp, Homo sapiens
cacctcagcctcctgaattgctgggactacaggcgtgtgccaccatgcctggctaatttttccgggtttcttttgtagaaatagggatcttgttatgttgtgagatcatgccactgcactccagcctgggtgagagtgagactacatctcaaaaaacaaacaaacgagcaaaaagacatggttaatacgttgattttatgaaacttgcctcaaagatgtttcctcttgtaaaggcacattggggctcttaaaatgtttcgagttataggacctcaaagctcctgtctgtcttgttcactgcctcagcctcagccatgaagagaggtcaaaatagaaacccaacacctccag

SEQ ID NO: 2941 - DNA, 441 bp, Homo sapiens
ctggggacacaggtagggggcatttgattctgatgcctccttagaaggagaatagcatgatttccccagaaaatggagacttggtccttttattttcttctgttttgcccaacgactaaaaaagagcttgtatgtatccggggaagacaacagagaatgtggtaagagagttaggcttggtgacaacaagaatgggagcacacgcacatgtttgcaaggttacacataaatatatgcatacatctgtgatctccttccatagctgttctgccttttccgtcactgaaataacaactaaatcatctcatgtcccatatggcagccagactgtcacaaagttaatggacataaagttcacaagggcttgtggtacaaaaagtaaactttttgaattataaggaagtaggtactacactggtgcagcaaacactgtccagccat

SEQ ID NO: 2942 - DNA, 98 bp, Homo sapiens
atggagttggacagattctgttagctacttcaaaatatttaggcagaaggaaggaacttcagggcattcagggcagttttcctggatcctccactgaa

SEQ ID NO: 2943 - DNA, 97 bp, Homo sapiens
agctcaagacatggggctgcttctgctggggcaatacttaatggtgttacatacaaaggttttttttccatattgggggaaatatttttaggaagga

SEQ ID NO: 2944 - DNA, 21 bp, Homo sapiens
atcaaaaaagagtatgaaagg

SEQ ID NO: 2945 - DNA, 200 bp, Homo sapiens
gggcaatttataaagaaaagaggtttgtttggtcaacagtcctgcaggctgtacaagaaagttggtacaggcatctgcctctggtgagggcctcaggctgcttccatcatggtagaaggtgaaagggagctggcatgtacagagaccacatgatgacagaggaagcaagagagagcagagagaagtgccagagtcttttg

SEQ ID NO: 2946 - DNA, 124 bp, Homo sapiens
aaagcaaagggttttgtatgacaaaacaagcatatatcaggtacccccgatatgtttactacctgagccttattgtgtcaccaaaaaataccagaaatactcgtcaaagatttagacccacaca

SEQ ID NO: 2947 - DNA, 59 bp, Homo sapiens
tgaccccttgttgtatttctgttggacagtgcttatcggatgactaccaagccctgcac

SEQ ID NO: 2948 - DNA, 160 bp, Homo sapiens
ctgatcccttgttgtatttctgttggagagtgcttgcctggatggctaccccagccctgcacttctgagctccatgaccccttagaaatggtttcctcatctagaaacaatgcaacagcaacaaagaataataataccatgctaacatccatgctgggtt

SEQ ID NO: 2949 - DNA, 177 bp, Homo sapiens
cctcagtttcctcacctgcaaaatgaggatgaggacaggacacaccccatgggatcacgaaaggatggaacaatgccctccctctatatgtgacaggccaagcacagggtagtggaaaataaacactgacttcattggcaatcctctttactgagtgcagttgaaattgcctcttac

SEQ ID NO: 2950 - DNA, 78 bp, Homo sapiens
gaaattgcttctcgtgtccaggaaagcacctggtgctccagaaacagagaaggcaaaaacagaaaaagacccactgga

SEQ ID NO: 2951 - DNA, 340 bp, Homo sapiens
gacccactggagacacaatcaaataaaggtaatagaaaaagagaccccagcatcacttattggtgggagtaaaaatttcacctaagaattacatgtggagaaaaacatgaacgcatttgtgttcagactgttcaaatgcatgttgtcccacagagagcttaataggttgacttggcagaccattaaatctcgcttctgtgtctcttgccttcccttccttggcgtcgtctgtgtcttttgttgtggaaaaagctttcatcccatgccgacagaaatcactcaactctcacctgaggcactcatttaagagcatgcctcagaggattgtgtgttccttgga

SEQ ID NO: 2952 - DNA, 125 bp, Homo sapiens
ggaaattaagaggaacaaatatagagattaatactatttgcatattaaatgatgatctaattataaaacataggaagttaaataaaaatattagaaacaatgagataattccataaggtggctag

SEQ ID NO: 2953 - DNA, 22 bp, Homo sapiens
ttattataaaaattaatgctgc

SEQ ID NO: 2954 - DNA, 93 bp, Homo sapiens
ctatatatgatgaccacttactgaataaaatggggaaaaaagtctcatttacaaaagcaaaccaagataaagtactgtattgaaaataaactt

SEQ ID NO: 2955 - DNA, 372 bp, Homo sapiens
taataataatgctaactatatatgatgaccactcagtgaataaaacggggggaaatctcatttacaaaagcaaaccaggataaagtactgtattgaaaataaacttatggagtgggaagaacccttatgaaaagaattttaaaattctactgaagaatgtggtataatcctccaatacacgaaaataaatgcagttattgagaggaaaacaatactgcataaaaataaattctgtccaagttactctacgagtaaaagtgttatttgttcccaaatcaagaaaaaaccaagtcaccttgggggaccagaatcaggggaaagagatttaactgggcttaaagatgtgttacaaggcggcacggcatatgttgg

SEQ ID NO: 2956 - DNA, 327 bp, Homo sapiens
gtcatgttagataggctcacagcctgggtggcggtgttggtaattttcactgcctccaacttacagtcacgtattatcaccaaagtgactcccctcctcccacatgagtctgagagggctcctggtatatcaaaaccatgtgaaaagcaatcgtgtcctttggacattttagtgcattagctcccactgaatgtaacaattgtggccagtgtggtggctctcatctgccaggcatggtggcacatgcctgtggcctcatactttggaggctaaggtgggaggattgcttgagcccaggaggttgaggttgcagtgagttatgatcgt

SEQ ID NO: 2957 - DNA, 29 bp, Homo sapiens
gtgagtctgaaagttttctttaaatttcc

SEQ ID NO: 2958 - DNA, 50 bp, Homo sapiens
cataaatcaaatttctttcatttgttttaaaaatttttgcaaaagtaaag

SEQ ID NO: 2959 - DNA, 601 bp, Homo sapiens
gcacaatattttaaagccactctcccatgacttctccaatacaaatactgggtattttattgtatttctgtctggttctccccctctaggtttttatttttcatacacatgtaattataatttaaagattttatatacaatagttttccatcatctgagtagtcactatacggctcattatccaagtatttacaccattatgtgtttagggaagcaaaagtcatcctaacataaaaattgtcactaatgaactgacaacttgacaattatccccctcaaccatccatttcggagtaatacaaatattgctttggaagccatcagatcagtgtgtttgtcactgtttatctctgattgttgatggttgcttgaaactcaatgacacaattcaaaactatgtgaaacaactgcagagtgaacattgaaaatctttgcaaggggcagcaggatttcatgaagtcaatgaaagtgatgttggagagctacttgcaatgcagagaataacattgttaagtgaggaacttgcagtgagactggttaacaacagaaaaggagatgacaggtggatgatagtgatgaacactttgaaataaaatgaatg

SEQ ID NO: 2960 - DNA, 208 bp, Homo sapiens
ggaatgaatggatgatcaaatggtttaaaaagccctctgaggcaccttgttttggcccacaaaatgattcccaacaaagttcaagattacataactgcctttaggtttttgaggaatcaccacactgtcttccacaatagttgaactaatttacattcccaccaaaagtgtaaaagcattcctttttctcccattaccgggtacatgc

SEQ ID NO: 2961 - DNA, 100 bp, Homo sapiens
cagaagttgtgttgaagcagaatcatgtcaaggtttgggtgtgagagtacatctggttttacattactaaagttcatttgcttatagattgtagaagcac

SEQ ID NO: 2962 - DNA, 1663 bp, Homo sapiens
atgctttggccgaggaacggggatgtttgggtcactgtaggggaagctggctgtagccatcattgactcctgggcccactttggccgtcacctgcagccttgctgtcttcctccctcaagtgcccgtgcctccctacctgagggaagtctggaattgctgtggcgctggaactctcaggcatgagattcatgagggacagatgttgatgggtaaatagtccagcattcttctgcttccttaggactgttctgaaacagattctactcggtccccaagctgtccacagtagtcacctgctcactgatagaccttttcttggttccctttccttctgcctcgccttctccattctcataagtattcctggtatcacttcccaaatcaacaacttacacccaaatctttgtctctagatcttcttctgaggggatccaaattaagacaatcaccaatcaatatgttgtaaagagagaactcagaaaattgatctggtgagcgtactgaatagaagctccataagaaatgttccactgtttttggaaatctcatttggtctctctgtcttctgactgttaagcagttttcatccttatatttacacacagggtcctttctcacaaccaacattttgccttcttctttgtgagcccatggaagacatgtgttggggaacgtgttacaagcttctcgctggggccagagtttgactggtgtcttgctttcatccttctgccccagttcacctttttaactcttcatttgccctgaattttacgaactggtcatcctgggtctttggtaccttctgtggctctactttagtctcctatcctctagctctgccttacctagacctacaatttacctgtggttctgggcccctgctataggaatctactctaagctgagatcctgtcttggatttatgccctgaaactaccattcccacttctcattctgtgtctcttttcctcctaacccttccacttccctggactgtgctcatggccctctggcccatctcttgcctgtgcacttcaggtggtgtttctaattcatggcaagtggtatttctaatgcgtggctttcaaaatattttcctgtaaaacttaccttcctaccacttagagccatctaaatgtttttcttcaaagatacacaatattgaattaatgctctttcagaaacagaacgaaactattgtactgtctctcccccattcttaagaatgagtgtttggattgtaaagtgattgaaccacactcgattctctcttattaatggaaaattggccataaattgctgaggcgtgactagctcatttcccaatacagctgcaaatgctttatgtggggatcactttcgatttctgagaaagaaaggagaaaactctacagaactgacacctcactaaacagtacctcgtgtcactccctaccgagaactactgttctgaagaggcaacgaattgaagatagtgccaccttcagccaaggctgtttccttagagtgcatatttttaatgtttttatggtgtggtagatttggctgcaagctttgaaaaggcagccattaaacattttcgtttttttcccaccatttaaaaaactagtctaaaatgcatatatgcctgagaagtgctctgtatttagcgcacaattc

SEQ ID NO: 2963 - DNA, 531 bp, Homo sapiens
atatcttctgataccatgtctagtattccagtagatatccatcttctgtctcccccaccaaatcttcttttctcctgggatcagccctccctttggaaaattattttttcctgacttcagatgaaagtcatagagtggctgctaaacactgtgccccactgaccccatttcccagggtctataatccatgcaataaaaagagagttgcagtcagcattttttttttcttttagtgagaaccaagagtcacttcttccctctcagttaatgaacttcaaaggtcttctctgtcatgtttccagtctcataagaaaagcagtaaagtccatgagaatgaagctgacatgggaagaggaatcagaaatgatgaaagggaatccttatggtttgtaagtagcttgtgccaacccatgaggccagctgatcccatgccttatatagctttcttaccacgtcaatacagtcactccttcccctaaccctaggacttgggggtctgccatgtgtgttaaaaagaaacaggtattgggt

SEQ ID NO: 2964 - DNA, 32 bp, Homo sapiens
ccagagagagagagatacaggtattccagtgc

SEQ ID NO: 2965 - DNA, 338 bp, Homo sapiens
tagtatacctactgctggtggataaagaaggtgaaacaagacagaattctaccagttgacaaagtatacttttccattgctgtggaagtcaaaatctccatgtagtattaactcagatgatcccgtttttaaattaacaaccattttttctccagctcactttatatcgcgaaagtttctatttagtttaatcatttattgagcacctgtttcacctaagaatcaatattattggtggaaagttgaacaaatgtataagatataatccctgaattctaagcattctatagcttttttttttatttctctaatgtgcctgttatttttcataccaggag

SEQ ID NO: 2966 - DNA, 886 bp, Homo sapiens
ttgccaagcatccccatctcaggctctgcttttaaggaaccagacctaagacgccctcttcttaatgtctcatctatatcttcacatccacgtcatgtttgtcttttctactggctcttgcacccacccaatcacacatttgctatgttggtcaactggaacagaaggagcatcttggtggtttcaggatttggtaccatatccgtataccccatgctgcacagggctactcagctggctaagctagtggatgtaaagagtgagggatagcctgtatttcctaaaatagcatagcagcaactgcactaattttagataaggacacaaaatgcctggggatataaagatgtgtgtgtctgtgttttaatccaagttgaaattatacaaagaaacttgcaagaagcacaagaaaaaagacctatattatgattttcacttgaagtgaagtaaatggaggggctgggaaatagatgccaggcacccctctccaacgtgggtatgcctggctgagtccctgagactgcagagtggcagtgttgagtgaccaccatgtgttcagcgaggagtgaatgccagaatatgctctaaggaaaagtgcagataataaacttaaaaagacaacttagcaaaattggtagtttctcaaggagttgggggtcaccaggtgagtagtgaggacagagccagccataggataagaagagaaaaggcagaagaagggagaagaagctcagtaaatgccagatggggtgcttgttgatacatgtattccagaaagtttggctggaaaatgtggacaaaaagaattgatcttgattgggcacatatattataaaacaggaaatagtgcttatctttttacaattacgtgaagtatgggcaatgt

SEQ ID NO: 2967 - DNA, 300 bp, Homo sapiens
attatatgctatgttgcttcctgtgccaactatttttctgctctataacctcactgcatccctttgaaatttattttctccatgtcaaagaattggaaatctgcaactgactattgaccagactctgtcactgatattgtacagctaattatatatatctattttataactgtaatggttgttaaggtaatgttaaataatactttctaagcatctgttatatgaagagttatatcctctgcatagtataaggttgagtttctttttacttcttctcagtttttcccctttttcagcttt

SEQ ID NO: 2968 - DNA, 100 bp, Homo sapiens
aaagatatgataaatgtttgatatgatggatagatatgctaattaccctgatctgatcactggatcttacatgtatgtaaacatcactatgtacctcata

SEQ ID NO: 2969 - DNA, 522 bp, Homo sapiens
gatgctttctagctatggagcagccagaattagtagttcaagcgcagggactcattaacattgtgatcggccttttttcttatgatttctcccagattctacttgtagaaaaatgtagaaaacagacatttttaaagtgtgttctcacttgggtcctcgtcctcttccttcattaattgagttgtccgcctttcagtcatactcagctctaaggtggaaccaccacaattgcaccacaacccttctaactcctgacctctgatcattgcctttgtccttaaccagttctgcatttctttcatagcagtaatcaagcaaaaaccacttcctagaaaagtcttcaccaacagctctataggttataacattgctatctttctagagccttgtagcgtatgtgaatatgtattaatacctcattcatacacatgcgtacgtgtagtatattattttagattaggaaaagttccctgagatcgccacagtccccatttccccattttataaatgaggcaccgaagc

SEQ ID NO: 2970 - DNA, 92 bp, Homo sapiens
tcaacatctgtgtttcttcccatgactctgtcaccactcaagaatgccaggacaaggcacattacatgcctggcaggttttctttctgtgtg

SEQ ID NO: 2971 - DNA, 47 bp, Homo sapiens
accctgatggattttgtatgactcatgttggtgtggaggacatcctg

SEQ ID NO: 2972 - DNA, 119 bp, Homo sapiens
aaaccagtgaggttacagaaatagcagctcaaggaagaagaaggaccaaggaaggatatgatttcaggcaaaatttcagccttggcttgatcccatgagaatctcaggagtgcaagtgg

SEQ ID NO: 2973 - DNA, 1600 bp, Homo sapiens
catgctgtgattctgcacccttagagcagaagcaccacagacagcgccaataccattcagcaccacggacagagccacgctctgacgtcttctgcagaaaagtcccatcaactattacactgacccaaagaatgaacgaggcaagaccactgagtgcccaaaatcagtgggataggaagtcagaatctgcaacagacacagatggctttccctctcccccctgccttttctgtaaaagagtcccaaatgttgcaattgtcctcacagtgacatttcccctatcctgggggcctcccgtccctctccccacaacagtgaagaagagggtatcgagccgggcagtggagtaccctggtgacagattagcactgccaaccaccgacacaaaaccatttggtgtggggaaatgatagatgttaacactcattttaaacacaggcaactgaattcctgcagacaggcgccacggctggaatttagggcacagctgctaggttcagataaggtgcagaatcagcccagcataccgcgatgttacttaataatgaaaatgtggtgattgatgctgctgtctcgagaatataacctccccatttggaggttttcagctcccaaatcatccattccacctttttttttttccccctttctttctttttttggaaaggcaatgtgtgtgtggtgggggtgtggatacagggttgatggggcctggcaacatgaagctcatgatgctaaataatttttttaaaagtccaaagagcttagtttgaaagaattcaattctagcaagctcacctgggacagcaagttcaacatgaaaaactggtttggacaagttaccttccatatttttatggtcaaaggcttcttttactacactactccccatttctatgatgtcacaaagagccaatcagagtttttgattcaggacctcaactcccacctcttcctgagccccaggaaagctggaccatttatctactgcctcctgaagagcatcccctggagaaaacctcagattctgcatgtccaaaattagtctaggttagaatatccaagcaagccctttttgctctctatggcaagtgacaccactcaaggcaaacacctgggcattatccaagactcctccttccccctcatctcccaagtccagcatctcacacctgctatttttatctcctaaaccactctctcttaaattcacaattcacctactttttttttttttagccctatagcgttaaaatacaacctcacccccttcccctaaatagccacctgggctccagcctttttctccagttcatctttcatcctgctcatcagaataattttcctaaatggaaatatatcatgccactcttctgcttaaaacccaacatcctgtaggcattcaatgtcctgtaggacaaagtccagtttccttaccatagcatcaaaatctttaaggatctggtttcagtgtatccctcaatgttactcacaatctttaccaaaagcacctgaaataaatgcttatttctgcctccttgcatttgcacatgctgttccttctgtcttgcaggaccttcctctcctttttctgcctgaa

SEQ ID NO: 2974 - DNA, 54 bp, Homo sapiens
tcccagtagagaaaagttgttaatctagagcccatggaagacttgggaagtccc

SEQ ID NO: 2975 - DNA, 200 bp, Homo sapiens
gtgtgcctgccagtgggagggggtttgaatgcggtgtcaacagaatctactagtcctgagagagttactgctttaaggaggctgagaggttgttttgcatggaatggaggcagagcccagactttatagatatctccattttcactcatgcaataattcatgtattcattcaaaagatcttcattgaacatctactctgt

SEQ ID NO: 2976 - DNA, 1142 bp, Homo sapiens
taattaggataggaaggagagatgtgtggctctcttcttgcttgcttttggaagtcctgctaaaaaatgtgagagagcatctctaaggcagggagtattgccttagagctgttgtcggtcatttacccttgagtataaatgacattttagttttttttccctgcaagtagtttgttgaaggggaatgaagaaaaaagcctgaggggcactgaatgctttggagaaaagccataaaatggcccaaaataagagttggggagacaagggctttgagacaaacttgctgattttgaatcttgcagccaccgctcctccctctgtcagggcctctctccctgtctctcacagaccttggagctggcgggaagaagcttggcttggagccagccatgtccagcctctgccttttttgaagccagaggtagcagctgcctatgcaacatgaactaagtgcccagctctactctctctctgctcaaccctactgccaacagccactgttcattgcctgaaattcccatcattaatgtcccaaagcctaggctgggtgtcctaggagctccattcttattctggctgtcttgttctgaccttgggcatgttccttcatttctctggatgcaagggccagattggattcatctcctctgaggtccctgcagccctagctgtctatgtgttttttcctcaccacagttaacctattaaggttgcaaactcaaggtggtgttctggagacccccaagagagctgggggatatctgagcacctggaatcgaggctgagcaccttcctcagtcttctggctggcagaagccgtggcccaggagttgggagggagaagggctctggaagaggccctcagccccttgtggccctttaaatgctgccaaaatgactcctgctccgtagattgctgcctggagctgtcagacacgcgtcaaggtcaggggtgtgcatctgccccagacacagcaataatggcttctaatggactgtaaacaggtgaagtttgctgcaaagacattgctgctgctggaacaataaaagcttctttcttcttaaccctctcctggattttgattatgccacaactacactgtctttaaacagggccttctccaaagacattcttgcctgga

SEQ ID NO: 2977 - DNA, 74 bp, Homo sapiens
tgcagctactgatgatttgcgctggactttgctaacagatgtaagagagataaaaagtgaccttggagctcaga

SEQ ID NO: 2978 - DNA, 100 bp, Homo sapiens
caataggatgattgtgagcattgaaagaaattagatgcatgaaatgcctggcacagaggtctcagtaaaggttagtcccctctcctacacccactcccct

SEQ ID NO: 2979 - DNA, 71 bp, Homo sapiens
cccagagcccaccccacttctcggggatgctgtccccaaggtcctcatgtgccaggcaggcagccagcagc

SEQ ID NO: 2980 - DNA, 887 bp, Homo sapiens
ctgacaactccagagaaggcgcatgggccccgtggcagacccgaacccccagcctcgcgaccgcctgtgacctgcgggtcaaccacccgccgcggctccacgccgtgggcacagactcagggagcaggatgagaaagctgagacggcgcagccacggcccggtgccttcacgcgcacagcgacacagccccagccagcggggcccacgctaaggcggaatcccacagaagcctacagagcgagcgcgcgcctgtgcttcccaaaacggaatggaaccaaggtgacttctacagaacgatctgaagccctggctggcccttatgctagtctcttgggagcgttccaaatgcagctcaatattacttacttgacttttatctttcctccctggttcgtggtatttataactgggtcatcttttaactatttgcaacgtagcttcaggggagagggggagggctttataaataacctgtattattattatgcaggttgattctgttccctgagctaaagggaacatgaaaatacatgtctgtgactcatgcccccccacccccactccagggtgtgctgaggagtctctcagctgccccggggtcctcgagcaggggagggagaaaggctggcgctgcgccctccatcgcgtgaagccaggggattttgctctgcgacaagctgacttggctctcgtattgtttgcagaatcacccagttccaaggcagtccctgcgggcaggtgcagctgtgcgggagcttcagtcctgtccccaacacccaggcagtaatggttccagcacggaaggtctacctacctcccactgcacagcccgagggctgtcctggaggcacagccatccgtccctgggtgggcaggcacgtttatg

SEQ ID NO: 2981 - DNA, 1166 bp, Homo sapiens
cacgcgagtcagcacgttccatactcgggtgatcgtgctcatcccctggtcatgtcatcgggatctgagtgccatccgagcagagagctgtggcccggtgccgggggtggacttcatctattccagggaaccaaggatgcatgatttgcaaacaaaaccagaagcgcaagccatctcctcgcctcccctgatagccgtgctgcggagcctgagtgctggagtcactaatttactgtccagtaactgagtttctagcgaccaggtctagttgtcgtgttactttattaaattttggtttgataagtaaaatccctcagtagaaactctagaaaagtattagcgtgtcatggtcatgagcaagccaaacagcctttctaaaaggtgggaaggagacccccaggcttcgccaggaccccccagtgagccagcccagggctctccactcagaccagattacgccccaaagaaccgagcccttcactccagaggtggttgtgtttggggctgtgtctgtgtctccagctttttgctcatgtggggaaggagcagggccggtgtggcccttcgctttgctgagtgcaggctgggggcacctccaccagctaaggaaatggctcgtgcacagtagcctcccgggctgctgcgacttcattcttcattcccaaagcaggtgtcagcctttcccgggaggcccagcaggtaagcacttgtggaggccccggtggctgctggttagctcttgaagctcgtccccaccctgcgtgcgttctaaagagccgcgtttctattgcaactgcctgccctgcgctttcatcttccccacctgtgctcctcccgcctctgcccatctccacagggtgctacctgccagtcctgccaaagcgtcctcgggcaccgcggcttgaatcagtgttagaaagtggcatttgtgactcgacacccctcccagctccccggcaagatacccccgcccgagttcccatgcccctgccttacctgtgcagggctcccaaccctgcgtgccgtggccgggggccgccaggggcagcacaaaacacagactcagcagggcagacatgaggggcttgggtgccaagctccatccagggctccgctcagcctgcagggaagtggctgctcctcagacgtctgcgtcagcctttcca

SEQ ID NO: 2982 - DNA, 1190 bp, Homo sapiens
tcactgcgacggccacatgccagcggcctaaggcggggacagaggtggccctggcggtcgcagtggggaagcttctggttgctgcctgcgggaggcaggtggcccctggcaggttgggctgcagccgctggtttatctcttcatttccctgatgggcttgggccctgcgtgcaggtgacaggtgataacaatctcggcccggcctgggattagtcgctggcaaagcacactttccaaaaggaaagacagaaatagatcgtgctgcggagagctgagaacaagccagagaaacttaggagacccgtttccctcaggcgcaggctccctgggctcaccgccttttaggaccaggggcacaggcgaccatggcaggccgggagcgggtggggcgggtgcactctggctgggggtttgggcagcaggtccccacagtctgctggagggtcccagaggcaggtcggggctctgctagggggtcctagaggcaggtcggggctctgctgtggtggggagggggggtcccagaggtaggtcctgtgctctgcggggggtggggggtggtcctggaggcagatcccaggctctgctgggggtctaggcggcaggtcccgggctctgctgggtcccccggcggcagcggccgtccatccccaggaggggctgggctccctcggagggctttttatctggtgcccagccctcccgagggtgtgtgggtttgtcaactgttgggtttcaggaatttccctctggagggaagtcggtccttaaagggaacagctaatgagaaggagtgggtgagtgtccctcagggaaggggcacggccatggtcactcatccagagccgaggaccctcgcatctgacctctcgacactgcaatgggcatgccactcgaggggagcagctattaactagaagtattctttttacaaaagtgccctgcccccctaccctctccaaacagcactgaacgcagcattcttgcagaaatctccaacgcaactgggtgctgcgtttctgtgcctggtgtggaggccctggcaaactggtctgaggccgatggctttccctggttcacaggcccacaaagtgcacacactcctgctagtttcagaaggaagcccccactctgggacctctgacacaatgagttttccaagagcatagaccctgtcattagggcttgtg

SEQ ID NO: 2983 - DNA, 793 bp, Homo sapiens
ctcctggggctctggaggctcttcccataaacagcccctgcgatgggacaggctcattctgtctccctctcgcttcctcttttacccggccctgcccccagggatattaattcatagttaatattaattcacagatattaattcgtagtcctatttatgaggcttgagttaactggcatcatatgaagggaggttgaaggtctcccattatatgtgactcctcttccagcacccaagtgagccctggggtggggtgtgtctccctcaccccccaggaccccctgccagctccggtgggcatgcagtgccaggacagaggcttcctgagtgggctccccaccccactggggctcagcagctggaaacgctccacatagcaccattcctgacaaccctaacctaatgagggacgacgtggttcctcagaggagcgaaaggcctgatcgttgtgtaaatggaataaatggagtcttcctcttttgtgtcccaatccatgagaactttgtcctgggccaggccgctcccaggccagctgcgggtcacagtggcctctgagaccacgcccctgaggggatggggactccccccaaatgatgggcaggtggcactccagagctaatttaaacaatcacaattaagctgccttgaacccttccggcaaaatttttcttatgttacatttgatgcagtagcactagtaatagcctcaaagataactaagggtgagccagtggaaatcctcctcacatacgaaacttcacaaagatgtgctgagcgcaggaggaaagctcag

SEQ ID NO: 2984 - DNA, 100 bp, Homo sapiens
ctctacagctccctgtgtgaccctggacaagtcacttacattctccaaggtttaacttccacgtctgtaaaatgtgcctaggaggacacatgtggtaggg

SEQ ID NO: 2985 - DNA, 162 bp, Homo sapiens
tcagcatttctggaaccacgacccagggaacaccagctccaaaatgctcgatgagaaaaagcaggtgcatttgcaggtggactccacagccccttcctcagggacacaagcttggctcacccacgcggagctctgagacatcagtgatcagaagcctgctta

SEQ ID NO: 2986 - DNA, 874 bp, Homo sapiens
ggaattctcatgagatctgtttcttcaaaggtatagggcattcccctttgctctctctctctctctcctgctccaccttggtaagatgtgctggcttcccaattacccagtctcaggtagttctttatagcggtgtgaaaatagactaagcaagaaagaaagaggaaaagaaaagagagaaatcctccacatcatgtgtatcaaagtctcatggagacgaatccccagaacccactaagagaaatgcatgtgcaaagaagaaagcatgtccctgccataacatcagacatcagaactgagcttcactcccgagaagcaggttgggtaagtgctgcattgttaacaagggaattcacggggcaccaggccctcacagcataggaaggaacggcagcccatcccaggtctgctaactctgcctccaaacgacaaaagagaaaatgttccaagaacttcccccaaacacatcctggtgcaggctgtcactcaatttgtctgcttcaagggaaacagagacgatcaatagaagaggaggagggctccatctatcctctaaggacacaggttgttaatcaagtcagatcagtaacaaaccccaggaggtcatcacgggcttcatcaagctgcagaagtaacccttagcgtgtcattgtttggccaaaggcggctgtgaagtgtgtccatgtctttaaatattcaacatgccccaaccagggaacaatgcattctccaagaaaacaaggaacagagctcaaagagaaactgaaaatgataactttatgttacaaaaataacactcttacattcactcctccagttttgtgttttattaaactaaaccatcacttctgtgatctatgaaccccagaaggac

SEQ ID NO: 2987 - DNA, 191 bp, Homo sapiens
ttaataatttaaagacacaaaaattcttccaggatacaccatcacttggtatataatgaccactgttgtatgacatttgaaaaggtatctaaaaaaaagagaaggcacacacgtggtgtttgacaatgagtttagatagactggggagtacttggcaagcctggacaatgagcattagccaactctctggg

SEQ ID NO: 2988 - DNA, 526 bp, Homo sapiens
ctggggttatatgctgttgggccaggccatccaaggctgggctccccatcattgagcagttggctccatcagtcactgagtcaactgaccaggcacaagtgaggtccattgtctccagaaaatgcaggctagaattccaatttgaaagtcatttagatctcattagttatttaataagagaataagagattattttctcacataaagagttctcttttttttcaaacaagaaatactgtaggtcttttatatgactaagaacaacataattattaatcttgacctccaaggagaggaaattttggctcttaaaatctaacactagaatctgacccttgacccattacattagggttcccatttattttttttttcttttgaagagatccttaaatagtagggtattaccctttgtctgctttatcctgattgcttctgtgtgtgtgtgtgtgtgtgtgtgtgtgtgtgtgtgtgtgtgtgtgtgtgtgtgtgtttagagatggggtttcgccatgttgcccaggct

SEQ ID NO: 2989 - DNA, 194 bp, Homo sapiens
tgcttcccttttttggatgctttgttttaccttgtcattttgccaggtgtttaaaatgttcatttagtcagcaatattttctttgagactttatgggtcttaaaatacaatttttattctaatgctcactaaacttggagacaatttttgaattacaatttttagacttttttgctattgaattgtatgtgtct

SEQ ID NO: 2990 - DNA, 47 bp, Homo sapiens
aagttactatgtgattttagaatctcttgtttttctaggataaataa

SEQ ID NO: 2991 - DNA, 129 bp, Homo sapiens
atgtcgcctttatacacattcttctcttcttagtgctgtttccaggcagtcccctcaggctttggtcttccctaaatgcagagattaagaaatgggtgccacagcccacccctctccactgaggtggga

SEQ ID NO: 2992 - DNA, 504 bp, Homo sapiens
cagaaagacccactgagtttaacctcaagcactcctgctctccttcctggccaccttcctggtccagccactttcgttgcccatagccttcactgcccaatagtctcccacatctccttcaggtcccctggatctattcagagcagtctctgcaaaacccagaactggttaggccagaactcccttcaaggacttctggttgcccccagaataaagacgacattccaggatgtgacctatagggccctggagtggtctcgcctgccacccagctgcaatttcagccctgcacctgccctcccttttatgctgcagccactagggtctcccaggcacgcatccatgatgagcttccgcctaccaaggctgcccccaggctgggccctctccctgaacacccttcctctgtccccatcccaattaactcctctgcggaaagccaccccattaggagctctcactgcactatgtgctgcccctacttcagggtggtggttttcatcc

SEQ ID NO: 2993 - DNA, 24 bp, Homo sapiens
gaactcattatcttgactgtgggc

SEQ ID NO: 2994 - DNA, 36 bp, Homo sapiens
tcttcaccttgcaacatttaaaacacttttccagcc

SEQ ID NO: 2995 - DNA, 69 bp, Homo sapiens
aactcttttttgttgttgaatcatttagatgtaaattattaacatgattttcactcttagatatctctg

SEQ ID NO: 2996 - DNA, 300 bp, Homo sapiens
gagttttgcagaatcacctcacatgcacgtggtctctgaactcaggacgagggtgacattgcgaggcacaggcagatgagatcttcttactaaattctgtaacaaaaaaagctcacagaggaacgtgtgggagaacgctcctcctgaccttgcgttggacagagaactttgacttggccccagaaagcacctgccacatgtagaatgtagacattggtagacactcagcttaagaacttctgtcctcgaaaacacagctctaagagtggacaggtaagccccaaggagaagaagacatca

SEQ ID NO: 2997 - DNA, 22 bp, Homo sapiens
tgtatgagtcaattttcatagg

SEQ ID NO: 2998 - DNA, 1213 bp, Homo sapiens
taggtaggttggtttaatggactcacagtcccacatggctggggagacctcacaatcatggcagaaagtgaaggagaagcaaaggcatgtcttatggcagcaggcaagagggcgtgtgcaagggaactccctttataaaaccatcagatctcaggagacttattcactatcacgagaacagcaggggaaaacccgcccccatgattcaattacctccagtgggtctcttccaagacccatggggaagatgggagctacaattcaagataaggtttgactgaggacacagccaaaccatatcacccagcaagtccactactgagtttatacccaatagatgcaacatgcctaacagctaaacctaaaaatgttcccactgaaatgggcagcagtggtaggaaaggtggatcgagtatagcgtcttcacagctgtgtatcatcctgagctacaaacagctgccgtgcacagcagcaggcattcaccctccacacccagtatcaaaacacagcagacaatccaaaggtgcaaactgcaaaattccgtttacttctttttcaaaagcaggcaaagctgaggactggtgatggcagcccagatactcaatggggctgactctagaggttccccaaggggctgggaatgccaggtctctctctccagctggtggctggctctcaggcccttccgtccggctagtggctggctctcgggcctctgcgtccagctggcagctggttctcgggctgccctcagcaggccctccctctccagctccgcagggggaagaccacgtctcttccctggctccactgactccccttttttaacaaaaattggcactactaaaagcaaacaaaaatttgctttctatccactgataggaacaaggtcatgtttgctttcccccgacaggaggcccctgcgggaagtaacagacacacgctcactctccgtttctcatcctctatcgaaaggcgtcggcaaatctggaaggggcggtctgcagctgagctctgctgattccttaatcagcacccctttgtaggaccccctgggttacatccatcttctcccatcataagcgacgtgtgtgtcaacaatgcttgcctgtttgaagattacgactcaagtagaaaagctggtgtctaatgttatctatccgggtgctcccaggaggatgatgaaagccaaccctgtgggccctgagtcagg

SEQ ID NO: 2999 - DNA, 1814 bp, Homo sapiens
gccagggctggtttgagcatagacaccagggtgctgttccgccaacgcgtcctccactatcggtgggtggaaggcctgagtgtttcctggtctgctgagggctcgtttgtgaatatccctttccgaattgccagacggttccctgtgcccatttttaagtatttttcatcacttccttatggatttgtagaagcactttctacatagggaacgttcactctttatcacataaatccgaagtattaccccagttggcagctttttaattatattttggcatagagaagtcataaatatttatttgtgcaagcatcgaaaatgttcatatatggctttcgccatcgttgtgggcttctggaatgacttccccacacagttattgtgtaagactcagcatcatcacacaagaaaatggccatttactttcttcatgagaattccagaaatatcgttttcgtgtgttaaatgcagaatatcctgtcacagctgtctgaccagcctactagctttacgtggcccagcctcagatctcagctgtgcttttatgtgtgtctgggagacactgcatctgaacagggttagtggggggtcctgagttttggagtctgctgtgtctgctcctcaaggccatcagtgaacttgaacttgatctctcctctcttttcagagagatcggcatgatccggcccaccctacaagtgcaggcagtcggaacaatgctcccacaaagcccccagcccagcgaggaggcagcaccccattcctgtggggccacggggagaaagccccctgctgtgatgggccgtgctagagaggctggagggcgcggaccaggcaggggttgcggacagggcagggggcgcggggcaccttccatcctccctggctcagcagggctgtgtgtggccggccaccttgggctctttccctgtccatgataccatgtagtcaggaacagggtgagctgtgaatgagttcccttgactgaggtgctggtgggatggagaggagagcgagggtgaagtctgagagccctggggtggggcactcggggcttcaggtccccctgggccctgaggacactcaacttcagctttcctgccacttcccagcacaccggctgccatggcctccccgatgaaatcaattatcccattgctacagtcagttaaaagtgaaattaaatgaattctgaacattaataacaggctgtaataagacaaactacctcttaatgatgcatagaaccctgatgaaaataaatttccttgtggggtgtgtgtgagtgtgtgcgagtcaggtggggaactcaagggggagtcttatccgcggaattaaaatgaatattgattacacagctgataattaatgatagcaatttttgattaaaaatgagttcatttagcaaacaagtggagtgtggtaacattacatctaaaaatagaatctagaagaaagggcccttgttacacaggcaggagtacagtgagctctttgatcctgaggccgacgcctctggattcgaaatgagcttctcactcagcagcccccggaacacacaggcctcccgggagacgaccgcctccgtctccccagcgggaaggcaacacggtgccgcggaggcccagcctccagccttccacaagatccaggggctcagggagaagcgattgggccttcaggtgcttctctccaaaatcccatggcttagacagattcagcaaaaatgggataaaacggggcagtaaccctggaagtgctgctgcgctgggaaggactcctccaccccgggcaggtttgttctgtctccctgt

SEQ ID NO: 3000 - DNA, 100 bp, Homo sapiens
acagacacatgcatacacccagacacacagacacacgcatacacatacacagacacagacacacacatacacacatatacatacacatacacacacgtac

SEQ ID NO: 3001 - DNA, 324 bp, Homo sapiens
caaggaaatgtttatgtggctgaattcagaaaaagcacctgcgaagcccttctgactcagagcagccgaaacgccgggtaagatgtggaagcctgtggctgcgctggtaataaggacagaaacgccgccagccatgggggctgccctcaggagagcgggacgggcaggagggcaccacaggtggctcagtcctgggcctgaagctagttgctgtgggcagcgtgcgggggcaggagcaggggcaggaccctaaaagcgggagaattcggaatccagacatccataaagccaggacaccccaaacggccacaatttggagcatga

SEQ ID NO: 3002 - DNA, 100 bp, Homo sapiens
ggagacagaggcagagagaggtcatgtttcttgcctgagatcacacaggtcataggtgacaaaggcagatttcagacctggggctggctgcagagtccat

SEQ ID NO: 3003 - DNA, 440 bp, Homo sapiens
ccctgctggcatccagcagcgatgctgaggggggccctggacaggctggtggtgagaggggaggggggttgtcagccttatgggtcagaggcaaggggagtgagtgaagggctgggcggggactgagacccagggtgggacagagcctccgtcctgcccttggagctctgggcaagtatctttcctcacttggtctcagcctgggctccatgaaagcaaaggtattgggtgagaagggaggggaagaatcttcctttccaccgggcccaagccctactctggactttccttctctttgaggttttcaagaaccagagtgttaggggactctgcaaagagcaccgggaagaccacccctgcctgctcctggagaacctcctctggccctgtggccgccatccaacctgcagcccacctctgccctgaagcacaggggagtg

SEQ ID NO: 3004 - DNA, 70 bp, Homo sapiens
tccctggctggagcggcagagctcagcggatggggccgtgggttctggaggtggacagtctcacttttat

SEQ ID NO: 3005 - DNA, 1017 bp, Homo sapiens
gagtctcacttttaatcccagctctgcccaagtggaacccgggagtccacttgggctagtggacaagtgtcaggaaacgctgcccagagaggacgtgggcagagtcaagaagggggagttacagtcatctgaataaagacggaggggaaaagggacagtgcaaggctggcaaggtcagtgggaggtgggtggatggggtggcaggagcaggtcctgccagcctgtgtgtcaggacgtctgaccttgtcccatgggcagtgggagttactacaaggttctatgcaggagagaggctggtcagatttgtgtctaatccccacaaaccctgccctgtgagcttgaacaaggggtcttcctttctaggtgggaactcctcctctgcaggatgaggcacccagccttggcagtccttagctcccatatagttctggtgccggattaggatgcagaacaaggcgtgggctcagcagagccactttgggggtaacttttgggcatgggagggccctgggcctcaaattgctcccagtgcaattggtcccacaaggcaagatgtttccctatagatgcttagatggcctggacctcaccttgacgtgcctcctttgttcccagccacactttggcctcactgggcctgtgtcgatcctgtagccccacggctcttcttggggagggaagtctttgtggggtccttgtcgagtgtgtgggtcataggcctgggtgtgtgaaagggctgcaaagcatgagggaagggggagaaaccgctgtgcagggggcaaaaccactgtgtagaaggcaagggggagagtccgggcatagcgccaggtggggaggcactgggggagaagacgggggaaaggaagcaggagccgaggggagactgggggactggtgcgctttttttttttttaacttcatgaaaatatttgtttgactaaaattaccctttttttttttttgccctttcagaaactatgttagtagttctgtggacacacttaattgaaaataaga

SEQ ID NO: 3006 - DNA, 353 bp, Homo sapiens
gctgtgtatacaacaaaaggacgaagaacactggtcaagatgcaccattagcgtagggcgggtaagtttagactagagaatgggtctaaggagcttaacttgactatgaagcatgattttgtcaacagggtggaaagcaaccgtgtatttggttttccactggatcgctgcttccgcctctgcaaaccaccaggaaataggctcttctaagcctcctcagatttcaaaatgcaccgaccgtatcacattattgtttcttcagagcaagagttgcttctttgtctcccctactgtgcattccataggtgactcagaaagacgcatttttagtttttgttgttatttggagtttt

SEQ ID NO: 3007 - DNA, 292 bp, Homo sapiens
ggaaggcatttgagcacagagatgcctgtccccccattttcgtctccttgaaaacttcacttaaggctgctgtgttcatgaggctttctgtgggtggatggaggtcaaccttgaagaagcagccgatttcagctggaggttggtgctgccctggacatcaggcccccagaagcaggggagaccatgggaacatgaaatgttggggtgcttttgcaattcccggagcatggaagtgggattgggcaggaggaggggctactgcactgtgatgctatttagctgatgaccttta

SEQ ID NO: 3008 - DNA, 100 bp, Homo sapiens
tatcccctcactggacagaggaggaaactgaggcccagagagtgggggcatcttgctcaaggccatgcatcaaatcagtcagaacccaaggacctggctg

SEQ ID NO: 3009 - DNA, 399 bp, Homo sapiens
ggtgtccaaccagcgttttagagcccccgctgcagtcaatcgctatcaggcaccctgtgtccttcccagagcattgctgaatacctggaaggaggcagagaacaccagcccaaggaaggaatacactgggatcttgaggaaggcaggagcttccttggtgcagtgtccccagctgcctatctgcctgggagtggcctgggcacccaggacctcctctccaactccaggcatcccatggagcacttggcagcccagctgagggatactccaggaggatcttcccttggcaggtagatccatgtcaaacggatccctcatccaaagccagcgctggcttcacgtgctgttttgtcttctcttcctctcacacgaacatacgctgtgttgttctttcctgaa

SEQ ID NO: 3010 - DNA, 240 bp, Homo sapiens
ctcataaattctccctctgggctttttgccaaggggctgaataaacaggaaggaaggggcaaataaatcaccaagacaggctctgggaaggtttctgactctggagaccgtcacagaagagctggccggcctccgccttgggagttgcagcgaggctgtgtagaaggggttataggagcagtgatatggggtcagcagcaggctggtgcccaggcaggctttcatcaacgctgcgacctt

SEQ ID NO: 3011 - DNA, 570 bp, Homo sapiens
gatcttttatacaacttggagggctctggagggagggtcttgctgagctgctctgatagtggggatcatgcagacccccggctttcccactctagacggccttggcgagagcccccagctgcccttgagttgggacatcctgggggtgaatgagggtagaaaaaggcagctgcagttggaggcttgcggctcagagctaaggcctccaccccacagcctccgctggctccccaggtgagctgggacaccaagatcagaggctggaaacaagaagttttggcttttagctggcagcagcagcagctgccaacatcatctctccttcaaatgacaggctggggactttgggaaaacagccacaataagcgtgttcggagggaaaggagggggagaggaaggaaagagagcagagaagatggtgaggtctggatcgtggggtgcagcgtgtgtgcgcacatgtgcttctgtgatcctcagtatgtcagtgtttctgtgactgtgtgtacacttacgctgtgtctctgtgattcaatctctgtgtgtccccagggagacagtgtgcgtctctgt

SEQ ID NO: 3012 - DNA, 117 bp, Homo sapiens
tagtgtgagtctctgtttatggtgatgggtggcagcgcaatgccttgaaaatgtttcctccaaggtagcaaagaaaagtccctgtgaccatccaaagccttggtgagctcagcggct

SEQ ID NO: 3013 - DNA, 33 bp, Homo sapiens
tagcaacacagccaactcttttttttttttttt

SEQ ID NO: 3014 - DNA, 100 bp, Homo sapiens
cagatcttgaagaaaaccggaattgtaacttaagttttatctgcgtataaccttgcagcggcatggcaaaggagacaggatctcacagaattttacaaat

SEQ ID NO: 3015 - DNA, 5 bp, Homo sapiens
gcaac

SEQ ID NO: 3016 - DNA, 1047 bp, Homo sapiens
gcccagcgatcctgccggagggtcttgaccacagagtgggggtgtgggggctgtgattcagattctccgaggtgctgatgcagctctgtggcgcctactgcccccgccccccgactgagaactgtggctgtgctcagccaccgtgactggctggggtatggctcggatcccttgggtgttggccaggccccagttgatctccaagggctctcggtgttccaggaagctatggcttggtgtctgaaacacagtctggagtaataaatgtcgggaggaaggatgtgactaggctgcacagggaagagaccaagacactttgagccaaatctctctttctcttgggaccccaagagctgattcacctggaacatcctggagccatgacacaagccatgctctgatggcagaggctgccagctgccacccaggacagagagcttatgggaggtggtggagttcctgctccccgcaaagcctgagggctggtagagatgtgagggtgtttcaacgttgctttccaagataaggaatgagttctttttctgtccttcttcttctgtccctggacagcctgactgcgtcaaagaaggaggtgggggagccagggggcagctggggtaggaagaagtccagcttggtgacattaatgggaggacagaattgcctggctcttctgtttttggacacgggcacagttatgaaactttgagcaaccccaggcctggggctggttcctggtggccctggcccacccctgcctgctgtgtgaggcctgtgaggtgcatgaggccactgtccataaatggaattgtcagtttattaccctcggtacccagcccagtgcctggaagttcttcccggatgtcgactgccgtggggagaagaggggcccactggccacagtgagggtgctgagctggagacgagttacacccgatctcatcctgggaggagactgtggtctggagggggtgagagcaaaaatgcagaggcttaaaacagaggtgagggcagagggaggcaggagagaccgggaaggattcagga

SEQ ID NO: 3017 - DNA, 100 bp, Homo sapiens
ctctaatgttatcgtctcctccctgctgtccactgtcccgccacacgggtttcttccagttcctcgaacacactaagccatgtccacccttggggcttgg

SEQ ID NO: 3018 - DNA, 155 bp, Homo sapiens
taccgtattttgtctctctcccactagattatcacctaaaaccgagcaggggccatataggtcttctataaatatctcttgttagtcagcaaacatttattgaatgactgtatgaaggagaaaatggcttacctggctttggaagcttggggttg

SEQ ID NO: 3019 - DNA, 249 bp, Homo sapiens
ctttcactgatcagagcatcgagccccggtcttgctgacctcagggtgatggccctgaaagggggacgggaccagcttggggctagtctgaaggaagacacagagacaagagagccccttgagagacagggtcaggggcctgaacgaggggctatggagggttcgtacagccctggagaccatgggctactgggttgctaagtgctggaaacacctgcatgtcccccaggcaccacggcagctctgaga

SEQ ID NO: 3020 - DNA, 152 bp, Homo sapiens
ctttctctaaatctgaaagctgataacagctaaatacatggctggaatgccagaaatggagtcaggccaagtggagaacaaaaagcctggtttattctctcaaaaaaaattgggttcaagccaagaccttggaagagtgagtaagtgaaggg

SEQ ID NO: 3021 - DNA, 125 bp, Homo sapiens
gttgaattaaagctagaaagaaaaagagagaaatttcagaatgcattgaagagagagtaggacctacccttaaagtaaggggaaaaattgcaacatgtcagaatttcctctggatcaaggaaggt

SEQ ID NO: 3022 - DNA, 162 bp, Homo sapiens
aaaatatttaagccttattatccttttttataacttgggatctgtaagactgctttgtgaatttcactgtgttattatgaagattattataataacatatgggacatttctttgtaaaccataatatggccatgaaaatattagtgtttttatatctcttgc

SEQ ID NO: 3023 - DNA, 195 bp, Homo sapiens
acaatgttaaaatctgctaaatggtagagtaattggacccatggtgtaagcaattacttatgaccgggtctctaaatgttgtttgcttatagtctttagtattactcagtttttaaaacaaaaattctgctatgctaaatatattcatcaatgaatactataaaaccttctccaaatactctatttttaagttag

SEQ ID NO: 3024 - DNA, 132 bp, Homo sapiens
ttgggctaaggctttcttacatttagtgtctttttaaatcatgttttacagtcatttacccttcagtccttacctaagatgacatcttttctgtagcctccaatcaggcagatgattcaacagaacagttga

SEQ ID NO: 3025 - DNA, 101 bp, Homo sapiens
cagtattctttggtgtaaatgtgaaaaccatagcagtagccaaacagacccttgggttattgaaaacccagacacctaagggggaagatagttgtccacag

SEQ ID NO: 3026 - DNA, 194 bp, Homo sapiens
ggtccataataaatgattgcagactattgttatcctcatgcctgggacataataaatatccctaaactgttacatgaaaaatagaaattccctgagagcataattaggccagttatctccaagttagatttcgttcatgggacaaatggcagacttttccagcatgggctgaaagaagtaaaaaaaagaagaaa

SEQ ID NO: 3027 - DNA, 232 bp, Homo sapiens
ttttctttacttgataagagaagagtgacatttatggccttcagacatgggccaaacctgacagtgaacaggatctgtcagtccctgtgtgcaaccccaaccaagtccttatgaagagaaaattctagaagctaatactttcatttatgctcaacctggaggggacatttaaaaaacacagtaaaaaagtctctacagactttccaccagcttctacccaacttattactgt

SEQ ID NO: 3028 - DNA, 170 bp, Homo sapiens
tccaaactacatagccttccttagagaaaactactagatcatgaacaagtcagaacagagagtagagaagaaattttccatggaagagctgataattggagattttggggagagggagatgaaaagaattgaaatggagaagaaaaatccgtttttgtgggggaaaatat

SEQ ID NO: 3029 - DNA, 146 bp, Homo sapiens
agagagagaattgatgctctagtctgcttccatggggcttcaaatcctggagcaaatcactcccatcccttcctacactatctatgtacctttccagacaatttcaataaagaacatgacccctcatttgagaactctcagatctg

SEQ ID NO: 3030 - DNA, 227 bp, Homo sapiens
agagctctctcctgtggaccataagggctgcaaatttaggctaaactcctgggctttcacttccatctaaacctcacgggaaacatgtcttcctttaagtttgctgacaatgcaaatttcataaaaatcttttcaatacatatttcttactttgaattataaaataatctgtttaaagggcacatattaagggatactgcattttgggaaacagacagagctggtgc

SEQ ID NO: 3031 - DNA, 240 bp, Homo sapiens
tgaggcaggcccccaggaactgaaacctggatgaactaactaagtttacaggcctgcaaagctgcacaccagtaaggtcctaagtcatcagctttctagggcaaacctctctggcccggcacaggtcaggtctgggtaaggaaagaacctaagcatgacctctacatgcccccaagttctcctcagaaattacaaagaagccttccctactccatgctatgtcagccatacacagaattc

SEQ ID NO: 3032 - DNA, 136 bp, Homo sapiens
ctagtttaaacacttaccaaaataacagaaaacatgatgccctgataggcaacaagggggaaaaggtgtttctcaccaatacaaacctgtgcatcaccttcagaaatctccactcaggaaaaggcggcaattccag

SEQ ID NO: 3033 - DNA, 219 bp, Homo sapiens
catggaaccacttattggagactgtgaaaagaaagcaagcatgttacaatcctattggtcagtttagtagcctgaatgaatgactccttcatgatgaccccctgcactgtgccctggaatcagacacaaataagacaagacatgatctcaggcctcaatttgctgaagaattggtaaggaagacacatgtaaacagataattgtatgaaattctgccag

SEQ ID NO: 3034 - DNA, 140 bp, Homo sapiens
acttaagtggaaatcataccaattattactacttgaatacatgagtaaatttatttaccaagcacttctatgctccttaactgagaatgcagactgattactctatgagttcatttatgtcaatgtacagcctttcacta

SEQ ID NO: 3035 - DNA, 185 bp, Homo sapiens
taaatcctttaaaatcaagtcaatccccaaatatggaaaagataattctctttccatgagagaagttgaagtggtgccataacagaaattagccctaaatgtttcagaactgtggttagaagttaagttacataagaacatctggatggcaatcaatcagtggaagatattatatggtataaagt

SEQ ID NO: 3036 - DNA, 36 bp, Homo sapiens
gcaggatccagatagcagagagatggctggagaggc

SEQ ID NO: 3037 - DNA, 133 bp, Homo sapiens
tcccctctgaaagtcttacacatgagcacacacacacacccctctgagccttccagagcctagctcagcggtgtgggcactgcctcggacaggcaccccccaccttcctgagggtaatagccactctgctgag

SEQ ID NO: 3038 - DNA, 71 bp, Homo sapiens
gaaggttctcacagaggacatcttacccgttctattagccatgtgcccctgagggtccagtcattcctaag

SEQ ID NO: 3039 - DNA, 118 bp, Homo sapiens
ttctcccaaacgaggagttttggagattataattctcatcatgttaaggctcaggtaaaaaaaaaaaaagaaaagaaagagtaaacggagcttaaaaaaaaaaccagatacttagtgt

SEQ ID NO: 3040 - DNA, 96 bp, Homo sapiens
ggtttccctttagtccatgcttctaaaaacaagtacattggtaccaatctagtgttgctgtggagaaattagggtctatctttgttgttccacttt

SEQ ID NO: 3041 - DNA, 127 bp, Homo sapiens
ctgcccacactagacgttgcttagagttcagcttgaagccatgtgatgtgggtcactgcccaggaggacttttttctagtgctgtggcctggaggactttccctctagcctctcatgcaggtgtact

SEQ ID NO: 3042 - DNA, 177 bp, Homo sapiens
ataatgatagcaatccatttggaaggtaatttactgataactttagatttttcaatcaaaaaccttaaattgcaaaattacatattttgggcatgtattaggtaacaaaagtaaagaggcaacaaagaatctttgaacaacattgaacttcctgctctgaggcagaattatagtatt

SEQ ID NO: 3043 - DNA, 57 bp, Homo sapiens
acatattactgatagataattcagtccttttcaaaaaatctgtagataagtttgttg

SEQ ID NO: 3044 - DNA, 147 bp, Homo sapiens
gtgaaatttgcaaagaaggctttttttttttcctgttaattttagcctcttattagagactactgccctactttcctgccctgggtagctctagtcaacctggcagtatctttgcatgaaacccaaagaaaaagcagcctgtgccag

SEQ ID NO: 3045 - DNA, 140 bp, Homo sapiens
ctctcatcaagtggtttctcttcctcccccatcaccatccagctcacagggatttgtcattccccaggcaccctctctttctggaactatcacacaagaccagaaaatcatgtgtgccataaaatgagtccaaatttaaa

SEQ ID NO: 3046 - DNA, 71 bp, Homo sapiens
aaccagaaaagctgtgcagtgacccagccccttaatgaccatgaatgaccctgttttctctctcttctcat

SEQ ID NO: 3047 - DNA, 130 bp, Homo sapiens
ctactaccttacctatggcatcagagttttgtttccccatgtatatcctatctcgataccgtggtaaatgtatgagtaaatgtctgttaagattctttcatgagaatcatgagagatttattggtcacca

SEQ ID NO: 3048 - DNA, 130 bp, Homo sapiens
ggatagacatatggataatagcttaaaaatataaatatggtctttccagtcatagaaaccttccgatccaagaggtacttttcccactttccaaaaaatacagggctatatacacatacccgtaaggcac

SEQ ID NO: 3049 - DNA, 116 bp, Homo sapiens
aattcccctctgtggtcagcctagtctgagaatgtgctgttgggagactagggtgcttattaggatctcttttctgtgccctgccatgactctggcaactcagatggctcagagag

SEQ ID NO: 3050 - DNA, 182 bp, Homo sapiens
ctgggtgggctggttccttaaagaccgtaccctcgctatcaaccagaaaatcctggagagctgaagtgaactgcaacttgggttaggccccagcttgacagctcgaaatcattttttttccttcttgctccaactctgactgggacctgccatgtcccttaccttctttcccattttctgag

SEQ ID NO: 3051 - DNA, 134 bp, Homo sapiens
tttgaaaagaactgatctcttaaaatggcttccaaacattgggatagaagagcaatttttataacacatgaaaagcaagatataagaaattgaattcatgttcatgtgtaaagaacacaatagaacagtaattt

SEQ ID NO: 3052 - DNA, 245 bp, Homo sapiens
atgtcagggccctgctagtggaaattcacttctgtgtgttagaacaggtgtttctgtgagatcctcagagaaaccagaacagctagaagcaagaacattcccccaccccttttcagaaaatagaagcaagtttctgccatgaaagccatttttgcttaaaacaccaggctgaaataattgcatatttgttggggattgacagttgagttttttcatgaattttgctatcttttgacggtagcaaa

SEQ ID NO: 3053 - DNA, 146 bp, Homo sapiens
tactttgcagaatctacttggtaaagacactgagattctcaagataggaaacaaacaggttatctagtattaattatgcagtgactaggtggagatgctagtgtcccagccctcctccctgaggcactaagaatgaagagagagaa

SEQ ID NO: 3054 - DNA, 143 bp, Homo sapiens
ccctccaacctcacaatttgctgggggtctttaacgcctagaacccagaaatgtcacttaagcctgctgtgtgtgtctctctcaaggcctccaaaacctccagtgtccaggtgtcaagttcagagctagcagcagtcaagata

SEQ ID NO: 3055 - DNA, 149 bp, Homo sapiens
tgaatataagcaagggactaataaaatgtgtagctttaccttttctgcctcctaatgtatatatcaaatatatatcattttttgtctatttccactttgacaattgttatgaaaatctccacctgtagctgcctggcactattgtaaca

SEQ ID NO: 3056 - DNA, 310 bp, Homo sapiens
gtctcctgtggcaagtctgcctctggcgtctctgtgttcaaaggacactgtagctgcccctgtgtcgaggagcactgggcacaggtgtctgagtgtggggcacaggtaaaagggcccctgtaaccctgaatgatgacagccacgattgtcagggccctagagaaacgggcctccacccatgcacagcggcaggcctgcaggaatgaggccagactccttggccctcacttggcagaaaggtcattccactccctaaggaagagccaggtacccaaccccagcctgtcgttggctctgccggaggggctga

SEQ ID NO: 3057 - DNA, 201 bp, Homo sapiens
cagggataggggctgtgggtaagaaggcaagcttgccatgaactctgcttccctcttgatgcacacgcccctgcagactgccacaaagtagcatatgtccttctcttagtgtctgcccagcctcggcctgactcttggccttcctggatcagctgcctctggggctggacatgggtttttctcttaaatgcaaccactcta

SEQ ID NO: 3058 - DNA, 173 bp, Homo sapiens
ctgttcgtcccacccaggttgataaaggttgcgattcttcatgccaagaaaaaagtttttatccacaaatacatatggaggatcctttcaaggctgttcctcctggggtgctttagagagtcccagatcacataattaaagaccaagggtgcagactagcaggactggtcccc

SEQ ID NO: 3059 - DNA, 146 bp, Homo sapiens
ctttcctgtatgaatgcttaagtaattccaacacaaggaagattatggctactgatttaagtagaatatgggtatgagtatcatgtatagtggttcaggaggacagggattcagagagattccataaaaaaaactggtgcacttgt

SEQ ID NO: 3060 - DNA, 201 bp, Homo sapiens
agctaatttgtccccaggatcagctttcttggagtgtcatggctttggctgacacagaaattgcacctatagatgattctcctggccgccctgggacccagctgcaggcatgtgctgatttctagtcaatggagaattatttctagattgtttcaggagaaagaaataaatgtctgtctaattggagtcaatcttttagga

SEQ ID NO: 3061 - DNA, 117 bp, Homo sapiens
aacctatacagagcatgaagcacttttacagtaagaaaaaaaggatcaagctggtttcatcaaaaaaaaaaaaaaaaaaacctattacaccatccgaactgtataagcagacgacat

SEQ ID NO: 3062 - DNA, 233 bp, Homo sapiens
cttcatctcaaatatagcccttgtcccattggactgaccaccatcacttttgtatgtacaaacatttattgagtgcccagcacttccctcagtgcttcatatgaacagctgatctgcaggcatgaattatggtaccattgctaaatgacccagaggttatccaaagcaaaatgctaaactgtggataggagggcttctggtgtcatcataactctattttgatcattacctta

SEQ ID NO: 3063 - DNA, 250 bp, Homo sapiens
tggtggcatctattctcttttgtttggtcttttataactcatgtgttggattccagggcatgagagaaaacctacgtcctttcactcacctggcgagtgaagagaacattaacttgtatgcttctctcattccataaatgtttgggctatttgcttctttcttctcactcagatcgagattatatgatgaagataacagccggccttcatacacttggcccactgctgagcccactgcacctgagggagc

SEQ ID NO: 3064 - DNA, 180 bp, Homo sapiens
cttatatttatcagctggttctgtacttgtgagagaaaaagagactatcatttatggatccccctaaaacctgtaggacatgcacttaaagttttgggtgctaaatcaacttctctaactcaagtgcaggtggagacaccttagaacacaaggatcaatgtgcatcctctttctctatcc

SEQ ID NO: 3065 - DNA, 185 bp, Homo sapiens
tttgtaatatgagactatattggcacaaactatataccatacaagaagagggaaaaaaatgagctgaatcaatgaggacaaataaaactgtcttgttgcctcatggaaagaaaaggttcgaggtttaatttaaaagtacaggctgctagagtaatatcctttcttttcccttcagtctaattgtt

SEQ ID NO: 3066 - DNA, 178 bp, Homo sapiens
tggactaacccaatgtcccccagtcctctttggaaggcttttgtttacttgattaattggccaaagcaagcagggtcctgaaataggggacatgagacaagtaagtcttgattgggatggagggagagaaagaacacagccagaggccagggcagaaaggaccacaggagaggagctt

SEQ ID NO: 3067 - DNA, 265 bp, Homo sapiens
ggcctaaaccactaggagtttctggaaacagccacttccccaaacttgtcactctgccatttctagcttgttccatttctagcttgttccttcccaggaataagaggcactttagcagtagaattgaggagaagaagtctcagaccatgtccttcaggatggaaaagtgtggtccaagaacagagaagatgacaccagaggagagacaatgctcgttggagttgactaggtggcagaaagggtcaggagaggcacaggagccaca

SEQ ID NO: 3068 - DNA, 162 bp, Homo sapiens
agtgagtgagtaactgagcatcagaccactggacctgtttcctcaaatcatcatttcaagccagatagaatattccagttagaccacaaagagaaactttgaccactggagagaaaaatcctaagagctgcatgcacaagttaggaccctgcagttaatgag

SEQ ID NO: 3069 - DNA, 204 bp, Homo sapiens
gcatactctggtttcactctcaagtccattctctttctcatgttcagaattaagaaaacatgagacactgaaagaatggaggtaaagccaacaaacttttgtcatgctttttccctctattatgtgtgaagtttctctcacagaaagtgttgaaatacaaataaaatagtcacatgccagggatagaatgttggtttgaggcag

SEQ ID NO: 3070 - DNA, 135 bp, Homo sapiens
aagatagtctcttggcattcaaaaatttagcatactttaactcatatttgctgtgatgttaggtagtgaattattcttgttaactatctagcgtccaatgtgacatgtgtttgttgttacctacaacttatcaaa

SEQ ID NO: 3071 - DNA, 128 bp, Homo sapiens
cacacacagacatcacatcttaattcacagcgtgcatctaagttgattttagttagttgcatatgctgtggacctaaatgaccctcaccaagcagcatcacaaagttaccattccatcaaatggtttt

SEQ ID NO: 3072 - DNA, 146 bp, Homo sapiens
gtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgtt

SEQ ID NO: 3073 - DNA, 130 bp, Homo sapiens
ctgatccttagaagcatccttaaaacatttaaaatatacctcaaaaaagctggactttcaacaacaacaattatacaaatgtatacatactgtatctgttagagacacaccaagaatgaacaggaatctc

SEQ ID NO: 3074 - DNA, 248 bp, Homo sapiens
gcagagtgcggtagaagtttccaggaggtgttatctagaggcatctgagaggaaggtgggagacccagcagcacactttctgcctcactccctttatctactgaaaatactgaactgccataagacactttgaaaagggggcttcttgatttaaaaaggtctggaaagcagtgttagacaatttctctagtcctctctaaataagatgctatgtaacaatttgatgaaaattaacctacaaaaatgat

SEQ ID NO: 3075 - DNA, 110 bp, Homo sapiens
tcaatagaatcactctgggaaaatatttcttaggaagtgtgttgtttgtctggacatacacgtgtatgtttttaagaatgagtatctggtactattccaaatccaagtag

SEQ ID NO: 3076 - DNA, 142 bp, Homo sapiens
ccttggccttgtccgtctccatgtcagttggatctgacagcagggtctgttttctctctctcactcggcgacacatttagccacctctactccgcctcatcttggtccggtagggaggcaggaaggtgattcccctggaggg

What is claimed is:

1. A method of analyzing circulating cell-free DNA in a patient sample to determine copy number of cell-free DNA present in the sample, comprising
   (a) isolating cell-free DNA from a blood, serum, or plasma sample from a human patient;
   (b) preparing a sequencing library from the cell-free DNA obtained in (a) and performing whole-genome sequencing;
   (c) aligning sequences of cell-free DNA molecules to a human genome database;
   (d) determining the normalized copy number in the sample of at least one cell-free DNA that has a sequence, free of repetitive elements, that is unambiguously assigned to a first chromosomal region Hs3, region 26316904-26317098, corresponding to nucleotide sequence SEQ ID NO:3023 as determined by human genome build 36; a second chromosomal region Hs5, region 138546637-138546876, corresponding to nucleotide sequence SEQ ID NO:3031 as determined by human genome build 36; or a third chromosomal region Hs5, region 1895609-1895744, corresponding to nucleotide sequence SEQ ID NO:3032 as determined by human genome build 36; and
   (e) identifying in the sample at least one of the cell-free DNA sequences unambiguously assigned to the first chromosomal region, the second chromosomal region, or the third chromosomal region that is increased in copy number by at least 1.5-fold relative to a reference value from normal controls.

2. The method of claim 1, wherein said blood, serum, or plasma sample is from a human patient who has been diagnosed with breast cancer.

3. The method of claim 2, further comprising administering a treatment for breast cancer to the human patient having an increase in copy number of at least one region by at least 1.5-fold relative to the reference value obtained from normal controls.

4. A method of analyzing circulating cell-free DNA in a patient sample to determine copy number of cell-free DNA present in the sample, comprising
   (a) isolating cell-free DNA from a blood, serum, or plasma sample from a human patient;
   (b) performing sequencing of the cell-free DNA obtained in (a) using an Illumina or SOLiD next generation sequencing platform;
   (c) aligning sequences of cell-free DNA molecules to a human genome database;
   (d) determining the normalized copy number in the sample of at least one cell-free DNA that has a sequence, free of repetitive elements, that is unambiguously assigned to a first chromosomal region Hs3, region 26316904-26317098, corresponding to nucleotide sequence SEQ ID NO:3023 as determined by human genome build 36; a second chromosomal region Hs5, region 138546637-138546876, corresponding to nucleotide sequence SEQ ID NO:3031 as determined by human genome build 36; or a third chromosomal region Hs5, region 1895609-1895744, corresponding to nucleotide sequence SEQ ID NO:3032 as determined by human genome build 36; and
   (e) identifying in the sample at least one of the cell-free DNA sequences unambiguously assigned to the first chromosomal region, the second chromosomal region, or the third chromosomal region that is increased in copy number by at least 1.5-fold relative to a reference value from normal controls.

* * * * *